United States Patent 12,594,311 (LACTOBACILLUS PLANTARUM PDG8 AND USE IN TREATING CARDIOVASCULAR DISEASES) - sequence listing, part 2

SEQ ID NO: 17 - DNA, 52468 bp, synthetic construct
  source 1..52468: mol_type = other DNA; note = Lactobacillus plantarum PDG8 - contig 17
ttaagctatatatttcgacggcggatatttcttccgttaaagtcaagcaagccattagattcaaagtcacgcggaacgtaccgaagccaattattttgggcggtgtggtcacaaagattggggtctcaccagtcgaggagagtaaagcgactttttatgaagtgacagcggtcgttccgattacagccgatcaggcacagttactacgctacgggatgattgggcaaacggcgattattacgggcaaggtgacttggtttgattattataaagataaggtgctggataataattgatacctgttgtgacagataattgcagaatgtaatcaatccatgtaatggggccaatggaacacctatacgaattttagcggtaggagaacgaacaagttaagatcaattactgaagtgaaagcgtctctaaatacttcgttaatcaaaaatactttacgtgattatcttaaaaaggttgggtggttaagcaatcttgtttgactagtcattttcagtatattaaattttgtgacttttatcagagaagttgatggtgctgaaaccagtcaaatgccagccactaaattagctacttttattgtgctagtggtttcctttatttttatcgtcttgatccaacttgtcttactgccatttattaagcatagaaagtaaaatcgagtttcggggtccattttacaaacaacccctcaaagaacattgttaaaataaccttcaatatctatagtgtagatgttggggggttattttaatgttattaatttgaattacccatataatcagtcctttttgtgcttcaaataaatcgttacaaaattaatccaagcaactagggtaccgactaaaaataagaataacactgaagatctcagactaatctcagattcattaacattattagttacgttaacccaggcactaaatcagccttatcaaggcttgaaccaacaagttcagcgagcaactagtccacaacaaaaagtgcagtttaagaaccagttaaatgatgtacaacaggaaatcagcaatcgaactcaaaaacaactgcaagcatttgctgaacagaatccggagatcaaacaacccgaacccgaacttgatcaaagtctaaaacgttggccagtttttaaaggtcatgctataatgtagacagaaaaaagaagccctgctggaacaggacttcccgtgcaagccgcttcaaaggcggtggcaagttattcaaacgataattttgtcgccctgcaacctaccaaagttgagcagggcggcttttttatttgttccttttgtcgatgtatgttaacaacgctaaaacaaacattgcaaacagcaacatcaacgagagtgtctggaagacgctcattgactgtgaaaccttcctgaagattcttccatgttcccatgggcctcacctcacaaggaaaacgacagccatcgcccttaaaacattctaagctttatagtgaatcgattatccgacgggatagttgattcactattttagttttgttctaaactttaaatagtggtgaaactatatgccgtaagaagtttagacgcttgacgtcgtccttaaaacaggcaattttacttagtagttagtattctcttcgaagaatgtcgacacttgatgtccagtttagaaaattagaaataattaccttagtaaatacgttccaaccactaacagctatttaggagggtttaaaaatgagcattgtctttggcatagatgtaagtagtcgtgattccagtgtttgtgtacttcagagtggcgtcacacgagaatataagatcactaacgatactatcggctttaaaactctattgatagatctaaaagaatacgccgaacatccacaaatcatcttagaagcaactggaatttattcacgcagaattactagatttttagatgaatacgattatgattatgttcttcttaatcctttaaaggctaagaaagaaattaatcagggcttacgtcgcaataaaaccgatcgcaatgatgcttaccatttggcactagctcaagatcgaaatcagcatcaacctaatcgaaaagagcctgaggcttatcatcaattgcaatctttaagtcgggcttatgaagaattaactcacgatattgtttcttccaagaatcgacttcataaatatttacagttaacttttccagaattagaaaccattttcaataactctagaggagttaattactggtatttagttgagctctttccacactgccaagatgttagaaatcttgacgtatcaaccatcgctaagcaaattaaagattttaaaggttatggtattaaccgtgctcaaaaactagctattaaacttaagcatctcgcggatttagcttatccagcagtcgatcaagacgacccagagcgtgatgaagtggtttattacgccaatagattattacggcttacagctgatcgcgagcggagatcagaggcaatgattaaattagctaagactttgcctaatcgtgatctagaaatcttaatgagtattcctggtatcgctgaaataactgccgtccgaattctagccgaattaggcgacattagaagattcagtaatccaaacaagataaatgcttttgttggtattgatccaggtagatatcaatcaggggaaaaagattctagtttaaggatctctaagcacggcaatgctgttgcgcggaagattctttatcgtgcaattggacaaatcgatctagcggctaagactagtccatgtcatatagcagattactatgaacgaaaaaagcaattttctcaaacaaaggggttcaagaaaattgccattgcttcaatccataaattgcttagaacggtctacattttgattatcactgatcaaatgtatgattacaacgtagccaacaataatcaaaaagacttttgtcgtaattaattgatcatgttcattatagcctaggttaacttcaaagaagtaatttctttgaagccttttgtgatgctccaaatttaggaataaaacgccccgattaaagcaatgatgtcaaatatgtcagaaattaagactttagagtcctaatatacttgactttacgtagaaaacttcttgcttggtctattatacaggcaatttacttaatgaccaagctctcaacaactattagagcaattatcaatgatggaggggatttttttaatgaatgcactcatttttcatgggtcagcaccgcatgctacagcagacaagttttggtataaaaacattgctcatagtttaaactctttaggaatatcaacaattgtggcggatttaccaaatcttgatcaagaatcgctaacagatacactcgttaaaattagagaaatgaacttaggcattaatcaaaacacaattttaatcggccattctgccggaacaaatattatcttagctttacttgaacaactaacaaaaccagttaaagctgtctatttgattgctggctattgtcaacctaatggcatgcgtcacacaaccttaaaaaaatcctatgattggaagacaatcaagaagaactcaaatgagttttatatattcaattcatttaacgatcctttcaattgtaatgaaaagcaaggaagaagtttatttgaccatttgggtggaacacttattttaagaaatgatggtcattttacccaaaaaaagctgccattattaatgacgctactgcaacaatactaatccccccccctttagaaaagtatattaaacggccactagggtatatcctaatgactatttatacttagtgctatacttagttttataaacatccatagaattgtccaaaattgtaaggatgagttgcgctcagatcagttccaatgatccaaatgttagtaatgttgtcctaaaggtactgatatttggcataacgggtaagtattacctgaaaaattaggagggtattcatgaattttgatgctgtcggtgacaatgtaagaggtcttttaactgcgacaagatcttatgttgttcctagatttcaaagagatttttcttgggatgagaataattataaagagcttttaaatgacttattatcacaaataacatgtgacgacaataacggcgatgttatagaatttaaaacatctcaatattatttaggaaatatgattttcttaggcacaaaagataaaacatcggttgaaattattgatggtcagcaaagattaaccacagggacgattttattagctgccattcgtgattcgctatacgctgcctcaaaaaggaaagatgatctggctttcagttatgccgaaactacacaaaatgaatacttagtaaaaaagatagatggttctcctcaaagaaaattacaaactactagtagctatccttattttacacaaactatacaaggtggtgcagatagcgagacttctatggagccatcaaacgatgaagaagaagcacttaaaaaatcttttgaatttttcaaaaagcaactaagccaaaataaacttttcagtaagctaaacatagataagcctcacgtaaaaagtaaaaaagacgaattatttattaatactttgaaagctataagagatcagtttttaaactctgaaattgtcgaaatatttgttgcagacaacaatcaggcacatcggatatttgagaatattaattcaaaaggtaaaccattgtcacaagtggatttgataaaaaatgatatatttagtaaattagaaattaatgatgtaggtgtagattaccccactcaacagtggaaagagatcaatcttgtattatctgacctagacacaacatttgatgaatttttccttcacttttggaaatcagaatatccatctgattcggctaatggctctaatctatataaaaagtatttaataagatttaaaagtgatgatgaaaatcatatttcacttaaaaaatttgtgaaaaagttgcaggaatcagccaaaacgtacgcaaatataattaatccattaagagacgattttaaaaaacaagaaacaaaaattgtttaccaatccttagatgctataaataagttccggggtgtacagtcaagggttgcgttattatctctattcaatagtggtattaaagtgaaacagaagaagttaaataattttctgtttttcctggctaattttcatatggctgcttttggaacagatttaaaggtacgttctaatttaactactaataaatataaaagcttttgtcaaaaggtcaataatgctaaaacacccgaagatattcaaaaaagtatgttagctctcgaaaaatcattacttgatcttatcaatgaggatgatttcaaaaagtcttttgtaaaattagtgttccagaaagataaagcaagaaattcaatgagtagctatcctgcttcctatgctataaaggtaattgctgataaaatggatggcagacaatataatgatgatgactattcgatcgaacatatattagacgaagcaggtaaccgaaaatccttatcaaatattggaaatataagtgttttagaaagaaagtacaacgatgaattatgcaacattaagcctaaaaatttccataacaatattgattataagattgacacctataacgaaagttcttataaaatgatcaaaagcgtatccaaaggttttaacgaagaatctataccaaaacgggcacaaaaattagctgattacttttggaatgaatttttaaaaatagaatgagtgttttcccatggtgaagaccaatattcatgttgattattttagataagaaataggaaaagcagggttatatgtattgataaattatttaagatgaaagcggaacaaaaaaatactgacgaattagaagcaggtcgattttatagatgagcttttaacaggagaaaggcatgtgccacaacttaacagttgtggcctcttttttgatgctgtataattaaagggttagaaccgtgtcattacttaatgacataagtaaggagataaaaagatgaaatatggctatgcgcgggtcagtaccactgatcaaaaattagcaaatcaaattgagttactaaaattggcaggagcagaaaaaatctttcaggaaaagtttaccggcacaactactgaacgaccggagtttcaaaaactgttgcgcgttctaaaaacaggcgatactttgattgtcactaagttggatcggtttgcacggaacacgcgcgaggcattagccattatccaagagttgtttaaagaaaatgtcaaagttaatattttgaacatgggcttaattgataatacgccgactggccaattagtctttacaatatttagcgcctttgcgcagtttgaacgcgacatgattgtcacgcgcacacaagaaggtaaattgtatgccaagcaacatgatccgttgtttcgggaaggacgaccgaaaacgtattctgatgaacagatcaaatttgcttatgagttacgacaacaggggatgacttataagatgattgaacgaaagacggggattagtaaacgcacgcagcagcgacgatttaaattagttaaaaacaacatattttaaaactgtttacaccataccaaaaggggcttcgaatacgaggccccttttagatttagctattaatccgtattaaagttagtggctagctcccagttcaactttttaatggcttacgatctgtcaacaaagcaatcggcgacaggatcaaaacaatcatcgcgcctactaagtaggtatgactgaaggcctggctgatttgtcgattcttagtatgcttaatttttctcaaagctgtcattaaagcttctttttgtgccaattgtttgagacctactaacaattttttctgaccctggcttatttgctgattacccaaattaattttttgagaagctactgacagtttagatatagcggtattttgattttctaacttggttaaggtaagtgctagttgctggttacccgcttttaagttgtcagtagctagtgctaacttcttctgggcttggtagacctggtgcagatcggttcccttttggggctgtggtaaatcaacttgagatttggccgcttgtttaagggcacgtcttaggttcgtctgtttgtttttagttgttaatttggctgatccagtagcggaaaataggctattcaattgttgatgagccactttcttcactttgggtgataattgctgtcgatcaacaatttgaatggcatcttgatgaatatgctgcttagctgtattgacattattatcaaggaccgttactagaattgcaattcctaaacaggtgccaatttgacgcgctgcgttaacaattcccgaaccaatcccacttttattttttggcaaatgcttaaccgaggccactaacgaaaccgaagagaacccaaaaccaacaccgttaatcaccagaaaagtaatgataacagctttaggcgttgtggtggtgataaacgacaagagcagtaagctagctgccatgactaagaggccaatcaaagtaaccggaactgcgccaacttgatcaaataacttagttcccaaaggcatcgctaccatgattgttaaggaaactggaataataattagggctgcatgtaacgcagtatcgttcagaacgtcttgtaaaaaataatttaaaatcagggtggggctaactaacgcaaagccagttaaaaagtaaactaaactagaagcagttaaggttttttcacggaacaaatctaattcaagtagtgggtgtttgactttactttcgataaagatgaacaatccaatagctaatacgccaccaatgagtgttcctaagatgatgcccgattgccaaccatattggcggccttctagtaggccaaaggttaaaccacccaagcctagtgttaaaagaatcgttcctggtaaatcaattctccccgccaaggattcgtcatatgattcccttacccccatagctataattagaaaggctacaatggttaaggggacattaatgccgaatacccagcgccaagaagcatattcaataatcacgccaccaatcggtggccccccggcagcggctaaagccgttaccgcgcccacaacgctagcaattttggacatatgcgctttgccaaatatttcaattcccattggtaagacaatcggggtgataatggcaccgcctaatccttgaaaaaatcgaaaagcaatcaattctggtaacgacgttgccagcatacaagccgccgaaaagccaccaaataaggctaatcctaataacataatttttttacgaccataacgatcggcaatctttgaaccagtgatcataaacacggctaaggctaacgtatagatggtggcaacccaacttgtatcagttaaactggcattgaaatgggtcataattttgggtaaagcaatgttgacgatagtactgtctaaggtgcccataaacatcgcaatggttaacccgataaaactgataattttagtagcttttgacatctatcaagcgctcctttcggtaacagatgaacacaaaggaaacatttgttacctttgtttgcagtctttagtataattagtcctaaacattaaaacaatccttattggctaagtgctacagattgctataatttgttaccgatagtgtatgggaggacagcaaaatgaacggaaagcagcgtatggttgagcagtctaagcaatggttatgtgacgcccttataaatttaatgacggaagaaaattttcaggatatttctattactgaaattgcccaaaccgctgaattatcacgaaaaacgttctatcattcttttaaaaataaagaagcggttattaattacctgtgtgatcagttgttcgatcagtactttgaacaattgctccagcagaaaccgcaggtaggggaaatgatgctaaaaactacttttgacatttttttaaatttttggtggcaaaaacgagatctaattcaattattgatccaacaaggcttatttgatcatatgaatgaaatttggcagcaaaaagcaatcccccgttatcaacagtttgcggctccctggcatgttcagggcactcctacccaggtgaattatgtgatggcttttcaactaggtggttttaccaatattctacgtgtctggttaggccaagatcagcctgagccaccagaacaaattaaggatttaatgttattggctgcccaacaattagctgatagtttgaataaaaattagattagttagacagaaataatcaggatttagctaagattatgaataccattcaaaatgagggactaccctatatgtattaaatttgccgtctatgacgggacttgctgattctaatttacggcaactgatgacgaaccttattattgaactatagtaagtaccaggctgaaagagcgtaagcggattattaaccggcatcaacagggcattgtcctggctaaccagcagggaaaatatcatggtcgtaaacagcaatataatgaagatgatccccgtttaaaacacgcctttaactttatcaaccaggcatgagtgacatagacgttgcccgtaataccgaaacgaaacagctaataaaagcaggtattacaaatgtaatacctgcttattttttcctactactgtcaacacgatcacctaagattccaactaatacgccaacaaccagaatataaccaactaaatcatgatatggaaaatcgtagtgattacttgcccacagtatgattaaaagaattacaactagggttgtgcgaagccaaaagctttttctcatactatttggctgccagtggtaatttaaagatgataaaagtcgatacagcgtaaataattaaaatcggaatcagtaacattccataggtgatgggccacgtcaaaatggtcattaaggcagtgccaacggtatttaaaattactaacgttttcctggttagtttaaatgaatgccacattaaaaaccaccagtagaccaatgagataagcagtacaaaacttcccaattcagttaatgacaatttatattcctcctagacgttgcttatttgtattagcactatggaacatattttagacaggctctctaaattaatacgttttgattttataaacgccaaaacgattaatgtccatataaagtttactatgcgggtgagcatctctcatattagtcaggtgatctgctatattgctaaaatagacagaaagggtaactccgactggtggagatacaagtgatccaaattcagcaatagcttgaccatttttgaattctgctatctctttatttactgctgtcttattgcgcatatacaccctaataccccaccaaaaatgtttaatagttggatttgatgaagacttggccaatactacaccgaatactgcacttgttgaagctccatatgtcttatcattagtcttgatagtatagccgttgcttttaatgtcagcattgacttgtgaaagctcatcttctatttctgtaaccacgctttgagagacattattattttcagggagctgtaatacgtattgattattaacaacttttacatatggatcaatttgattaatttgattctcagtcaattgattattttctgaatctgataattttgctgtttcagttgtttgaccagcatcctttatgacattagtttgttttaactgggtagtatctgcagaagccctgcttgttggtatatatgtggcagttaaaattgcacttgccaatagaactaaccctaattttctgtttttcattgttcatcgacctcctaaagtagcaaaatcttagtctacgaattatataaaaatatttacaagcaaaccataagtcttatttttagtattttcaattataatactcatacgcgtggtgctagttaaatttagacagtaaaaaagcctgacggtttacacttaaagcaatacacagtaaagaggtgttaagcatatcagactagtttaagccttatcagccgggaatgagtgatgttgatattgccgaagtacgtgattaagccggccaaagccgttacgttaattatttaataaattgtttatttatttgcctaataatgatataattaagctagatgaaggaggtatcgagatgaagattattacttttactgctatcaagggtggtgttggtaaaacaaccttgactttaaattatggtgattggttagccaaacatggtaagaaggttctattaatcgatttagaccatcagtgcaatttaacaaccgtttttgaaaagacacgacgaaacaataccatcgctgaagcgtttaaagaaaatgacaatgctcaaaaagtaaaaattgacagtgtcggaccgaatctagatttaatagccggttttatagacctagatgttttaggaagttatctagaaaataacagtaacaaagaaatgatgttgttcatgtggtttaaaaacaactccgattcattaagcttaaccgactatgactatatcttaattgatacgcacccagattttagcaccatcactaaaaacgctattgctatcagtaattacctgcttagtcccattacacccagtgaacatggctacaatgccaagtttgacctagaaacacgactcgaaaaattcagaaaatcactttttgattatcgaactggcgaaacttacgttgacgcaaagcttttctttattggtaatatgattagacataatacaagcatgtctcgcgatttgctaaaacacatagaaggcgatgaaacagtcgcaactataattcctgaaagagagctctttaataaagctactgcaaggcacgcttcaatatttgaattagccaatcatgatgaatccattttaaagcaaaatcaaaagttcatagaacacgccgatcatctttttcaagaattagcaaataaaaccaagtaaggagagttagattatgagtttagattcattcaatcataaaaaagacgaagaaatgagagaaagttacgaaactacattgaaagacaacaagaaagatgcagtcgcatttttgaaaaatatcagccgaaaggaagtagagcgtaagcgatcagtgaccttctcaattactgaaagtcaacttaaaaaaatggatacggctgcccgaaaaaacggatttaaaaatcgttcagaattcttagcttcaatcatagatgcaatttagcaattaaataaataattaatcaaacaagtaaatacacaatttattttcttgattaatttgcgcttaggtaaaagctagtaaagtgcactgaaccaaatacggttgcctgtaagtaagcgctatgctagactaagattaatttaacaaccaaataaagagatcaagctaaacagaaaaatccccgattcacgaggaatcggggattttaggtttagcaagtagctaacagagagctacttagattcagacaatttagaccgccaagttaaaatcgtctgaacattgttcttaatttgtaggttaattataccgcaaaccagtcctatgggacaagtgaaggatagttaaaaacaaattaaatccaatggactaagtagctaaccaatgctatttagtccatttttgttgttagaaattaaaaaaagttgccgtataggcaacccagaatagacacatgccggtgaatttacaaagccgatcacgtccaatgttcgctttgtaattcagttaaagcatatcagatttgtattttaaaacaagtcaggtgttttagcaactctcttttaagacggcgtgtgtcagttaagaaagggagcttttattatggatcaatcaaactttaactttacaaatgctaaaagagcctatgaagtaaagttctacgctttgccgcagatcttactccaaggagaaaaatataaggatcttagcgatagtgccattttactttattcggtgttacgcgatcgtctaagttactcactaagcaataattgggttgacgaaaataacaacgtatatttcatatacacaaacaatgaactaaaagatttacgaaactggtcaaataataaaatcaataagattaaacacgaattaatggacgcaaaccttttgtatcaaaaacatatgggttttaatccaagatcaggcaaaaacgaaccaaatagattatatttggcagatttggaagtaacagcaaaagacgtttatattaagcgagagccaataaaatcgcctgaatcccttggtacaagcggacttctcaaaaagagaaacccgtatgataccgttgaaccccttggtacaagcggacttctcaaaaagagaaacccgcatgataccgtttctgatacgcctgaatcccttggtacaagcggacttctcaaaaagagacaagatctagactatactaataatttagatactaatagatataatatagatactcaaaagttggacttttccacagcccaattctcaccagcagaactagaaaagcaaaacaaggatttggtgaaacatgctaatgatttcttaactgatgaagatagtggcttaccggttttcttagaaccagaagccgtgcaattacttagcttctggtgccgtaccccacaacaaatgcgtcgcttcatcggcattatcttaaatgctaagtaccgagttgagaaggatcatcaggatattggggtcctaatcccacttgatgatgaggagctgaaacctttaatgaccaaagccttgagacgctactttaacgctcttagaagcaatgagaagcacattaataacgttgaaaactacttgtacggcaccatgcacaacctatttggggtttggtggaataaacaagcggctagagaatatgcggccaaccaccccgaagagcaaaacgttgacaatgagcgcttttagaattaaacggtatataagctcatctaagccgttttaagtgttcggcacataattatattaaaaccgatttaaaaccgtttagaagctaaaataggcgccttaaatagctgaataggcgataactaatctagaaagatgggaaaggagttttttaaatgaccaaaccaagcaaagaagtcgaaaaaatagagcaattgttggctgacccctggacagtcaatatttaaggcatttgggaacaagcggaacataatccagaccctgataagcgcaagttgtttgacgcgttacacacttacctcttagataaacggcaagaaaaaaattatcaacgaaaagcatttcgtgatttaacatggacgagtcaaagaatcagtggttggaatgaaaaggaggcacaaaatatgactaagacacaagcatatatggacaagtatcaatttacagttgcagaaaacaaacggtttgctcgaacaaattttaccaagctagtacacactagtgcccgctttgaaggcgtaaataccactttgccgcaaacacaaaccattatggacggcatgagtgtggcaggcgttcctgttgaagatattttgacaattgttaacttaaagcgtgggtggcaatatatcactgatcaaaattcctccttaacgttaaccatggaaaaacaaattaacaagattgtggccgcggaagacgccttagtaccaggagaattacggcaaggaaaaggaggagttgatttaggcagtgaagacttttttgaaccacccttaattaacgaaaaacaagaacaatcctttttacaaaaaattttggctgatccgcaaacaacgaccactgataaagcattgactgttatgtatcataatatgcgccaacaaatcttttgggacgggaacaaaaggacggcgactttaagtgctaataaaattatgattgacggtggtgcaggcttaatcaatgtgccgttagataagtgggatcaatggaacgaactaattgccaattattatcgaactaatgacatggctaaaattaaacggtggacatatgacaatggcattcaaggattacaaattagagcaaacttagagcttaaatcagttgaagacgaaattggtaaaagaatccaagaacaattaaaagattttgcggatcaaaacccagaaattaagccaaaaaatgatccagaaaataaaaacgatcggcctagttattaggttgatcgtttttgagtttattcggtttatgggcattaatgtaatcggcaaatatttttaaaagctcttcggtttgttcaaccgaaaggttatcagcttgaaagtatttttccagcaaagctcctttttgaattaatcggcgagaacgagctttgcagtcttgccgactttcataatatttagattgccgtaatttaaaatcttcccgctcaattttttgttttaaacgcgcttgttgttcaactagtttttcatattgattaggcatagtcattaccacctaactattattggttattttgatcttgatttaaaaaggcggcaatttttttagcaatcattttaatttgtggagtggtcagtgttgcataattcaaattagatgatttaatgatttccttaccaaggctttgttcaattttgcttttttcagctttaatcttttgattaagctgttttaatttagcttcttgtttttctaagttactttgagtcacaattatccctccaatcatcttaaaataatcaccgacactatatcataagggaaacgctaagtcaaagtataagagttgaaatagcgaagcggaaggcatacactaaaagtaaattcaggagaatcagcagaccgagtgaaacgaggtcaatgcgcacttacacgtcatcaaagatgacgttgtgctaaacccattaaaacatgtattagaagtcgccgatggcgacaacaaagtcaaacccataaacccaaagaaaggtggtgaccgacatggcaatttttcacatgagttttagtaatattagtgctggtaaaggacgaagtgcgattgccagtgccgcttatcgaagtggtgaaaagctatttgatgataaggaaggtcgccactatttttatgcccgctcggttatgccagaaagctttattttaacccccaaaaatgcaccagaatgggccagtgatcgagagcagttgtggaatgaagttgaaacgaaagatcgtaaatcaaactcacggtatgcaaaagagtttaacgtggctttaccggtagaattaagtgaatccgaacagaaagaattactgacaaaatatgtgcaagaaaattttgttgatgagggcatggtagccgacgtggcaattcatcgcgaccacccagataatccgcacgctcatgtgatgttaaccaatcgcccatttaaccccgatggtacttggggacagaaaacaaaaaccgaatacattttagatagtcatggtaataaaactaagacccctgcagggaatgtaagaaaccgaaaaatttggttggttgattgggataaaaaagaaaaactaactgaatggcggcacaattgggcggttagtgtcaatcaagttttagagcaaaaaaatattcccaatcggatcagcgaaaaatcctttgaaaatcaaggaatagatgaagttccaactcaacatgagggaatcaatagtaagcggcatgaaagaaaagaatttaatcaacaagttaaggactatcgcaaggccaaagccagttataaaaataaccaagaaaaagcaatcaatagaggtcatttagatagcctaagtaaacacttctcgtttaatgaaaaacgggtagttaaagagctaagccatgaactgaaaacttatatcagtttggagaacttagatgataagcggcgcatgctatttaattggaaaaacagcaccttaattaaacatgcggttggtgaagatgttactaaacaattattgacaattaaccaacaagaaagctcactcaaaaaagcagatgaactcttaaataaagtggttgatcgcacggctaaaaaactttatccagagcttaattttgaacagaccacgcaagctgaaagacgagaattaattaaggaaaccgatagcgaacaaacagttttcaagggtagtgaattaaacgaacgtttaatgaacattcgtgatgatttgttgacccaacaattattgacctttaccaaacggccatacgttggctggcagttattaatacaacaagaaaaggaagtcaaaatcgagcttaaatatacgctgatgattcatgatgataacttagaaagtctagaacacgtcgatcaagggttactagagaaatattcaccaaccgaacagcaaaagattactcgcgcagtcaaagatttgcgaacaatcatggctgttaagcaagttattcaaacgcaataccatgaagtattgaaaagggcctttcccaaaggcgatttagatggattgccattgactaaacaggaacaggcttatacagccgtgatgtactatgatccaactttaaagccattaaaagtcgaaacaatggaacaatggcaatcaaatccaccacaggtgttcagtacccaagaacatcaattagggttagcttatttgtcgggacagcttagcttagatcagttagaaaatcatcacttacaacgggttttaaagcatgatggcactaaacaactcttttttggcgaatgcaaagtcgatccaacgattaagaacagtcaaatcgagaaaatccaaaagcagttaagagagcaacaagataaggacgatcaataccgaaaagaaaatatcgggcattatcaaccactgaactacaagccagttagtccagactattacttaaagacggcctttagtaacgcaatcatgaccgccctatatgcccgtgatgaagattaccaacggcaaaaacaggcgcaaggtttaaaggagactgagtgggaaatgacgaaaaagcaccggcaacaccaaactcgaaaccggcatgaagatggggggatgcacttgtaatcaaaatgtaaaattgaatggtatcaatgcacctatttatttgctaaactaaaaataaaataaagaaaggagaatccgcatgtggcaaacaaacaaaaatggcatagtctagcacaagcaagtcgtgaattaggacatgggcgcaactatgttagtgcttggttgagcagacatagagaagaattcccagaagaattaatgcttggttctgggaaaagcaagttaatatctgatgaaggcatagagtggattaagaagcacataaaaaaagagggcgtcctcgtcagcagtagagttgctaacggggatcagcacctagaaccgcaacttctaggtgtcaccctcctaacaatccattttaccgggcgggctgggggaaagctagttgtttaatatttctagcccagcaaaccacataaggaggtgactcaatgaaagtagaaagctggcaaggcattaatggcaagctagttcatgatgatcaaaaggcgattgtggttgataatgaccaagcattaaccgatcaaaaacagctacaagcaattttagatcaagacggccagccaatcgacgaagctcgccgagccatgattaagaagatggttaaacgtcagctaaaaacgccgccattaaaacttaggggctggtttaatcgccatcaagacagtcaaaatgctaaaaagtccgaaaaattggtgagtgacaaaccgacccatcaatataagcagatcagaaatgaaatgaccttttttggtgagagtttcctagaaggtttcttaggcttctatggcttagaagttgataacgccttagtccgttatgaacataacttgcatgtcctagagacccaagagttaggccagtcagaaaaagagtattacttagccacgagtgaaaatggccacgtcagattagccaccgacccattaccaagccagcaaattgccgaggaacaattgaacaagttctatcagcgtgagccagaagaaacgcaggcagaacaaattcaattacgaacatcagaagactataggaaggaggaataacatgtcaaaatacagaaaaatgaaagcgctagcaactactggagccaccacaatttacttgggcttgatgaacgcccaagttgtctttgccgcagacggtggcgaagttaaaagtaagctcacccaagctgggaagacgattcaaggtattttaaccgggttggtcgttttagtcgggatttgtgtcgcgctatttattattatcaaaagaatgcctgacgcagacgatccgcgagagaaatcagaggtttaccacgcggttggtcgagtagctggtttagttgccttggcggcggccattatctggctactaccttgggtttacagcctattcacttaatttaaaaaggagcctgccaaatgaagaaaggaaaagaatttatcttcccagagaacgtagataaagattacgggatctggaaagactacaccttgaaggattttggctatgcggcgctggtaggactagtgggcttaatttttattgcaatcccaccctatggtctgatcttagtcctgataaaaatagtgattgttgtcttagccatgacgattgtcatggctattttaacaattcggccagttgcggcgcggaagaatattaaagtgcgggatagctttaagctgaaacgccgctatgccaatggtcagaagctgttctatttaaaaccgaagaagcgaggtgaactaaatgcgtttgaaaaagagcaaaaccgccaataaatcagtaaagctcgattgggattaccaaccgcctaaaatcaatggtggcaaagagaccattgatgacatgagcttggtggtgggtatgtatggtaactatgaagttaccaaaacaggtaatctcgttggcattttggaagttagcgggatcaaccttgatttacttaatgaaaccgaacaacaggacgtttttgaggactatggcgcctttctcatgagtaccttaggtgaaggcgttgatgacaccttacagttcttagagccgacaattcccgtcaatatgacagcttatctcaatggtctcaaacggcggtatctcgccttacaaaaaggccacccggagcaacagttcaaagtccagctcatagccagttacttggatcactttactaaagtccaagaatccaaaaacatgacaactaagcaacatctgctaatcgttaaggtaccgattaaagacaagagcgttaaaagcttaaaattagccgtcactcatttagacgaaaagatcgaacaggttaaacgagacattgaaaatgcgttaacggattttgatgtgacggccaaagttttgactagtcaagaagtccaagagattttaaagaacttgatcaattttaatggatagggggaaacaggatgagttttggtgataaggtcattgatttatttatgccaactaaaaaagaaagacatcaaggcaacagcgaccaaacgggtagtaagcccaaaccggaggttgaggattttaccaagctgattgatcgcgatagcttgcattcactatttccgttcagctgggaacagtaccccacctacgtccagtcgggcgagaattttattcgggtgttagcgatcgctgactatcccaagcgggtgtatggcaactggttatcagaattaaagcgtaaaaaaggcgttatcgatattgtgcaatatatcgacagcgctagtaataattcaatgattacctattacaagaagacgattcaaaataaggaagcgcagaagttaaatacgttcgacccgtataaaaagaagattctgcaaaattatattgattcagccaacatgcaactagataaatacctcgataattctaccacatttgtgtaccaacatatgctgatttatctgcgggccaacaatttagcagacttagatgacttaaccgaaagcgttaagaatacgttgattaaactacaaatgaagcccttagtgcccgttaaagcgactttccaagcattttggtcaaccatgccaattaacgagaacctcatgggggattacacctataaagagagtaataccgaagttgccagcagtatgtttccttttgatgacgctgaaattctggacttaaaaccgagaagcgatattgaaggagttaacaaagataccaacagcttaattgccgtagatatgttggatcgcaacaagaccctaaatcaaaatcaagtgattatcgggacctcgggggtcggcaagaccacctatatgatccaaaaaatcctacgctacgccattcaagactatcaactctacattattgatccagaaaatgaatataccaaaattgtcgaagccctaggtggggcagtcttgcacctaacttctaatgctaagtacaaaattaacccgctacaaatcttttccgaagaaatcttaagcgccgatgaagcggtcacaaaccttgatttactagttaaagataaaatccagcgattaaaggggttctttgaagttcttaaaactgggattacccaagttgaactggcaatccttgatgatgtcgttaaacaagcctacgtcaacagtggcgttttgaaatatagccgcttaaaagaaattaaagacgatcagtggccgaccttatccaatgtttatgacgagttggaaaaattggcagataaggacgccgacaaattcaatcgggtcaaagacttctactacatcttaggcagttatacccatggttctaacagtttatttgacggccataccaacgttaacttaaaagggaaaatcatttcctttgatttaaaaccgctacaaagtgagcaggaagtccaatcagccgcctatctgaatactttccagtatctatgggacgaaattaccaaagatcggcatagccgcaagaaattgtttgtcgatgaatttcatttcttgaccttgcacaaagccgccgccacctttttccaccaagcctacaagcggtttagaaagtataatgctggggcgattgccggaacgcagcaaattcaagatgtgattgaaggaacaacagatactgggcagaacattggggaagccattattgggaactcctataccaaagtgttctttggccttgacggtaaaggcgttgatgatgtgattaccaaattgcgtatgacgttctcggataaagaaaagaagctactagaacgtcgtagacaaggcgaagccctgatgatctatggtagccaacgtgcctttatgcgcgtcgagttgaccgaagaagaattgcggttaattgatcccgaagcttaccaggaaaaatataaccgtgagaccgccaaccaaccggattatcaaaagcgcgtggtgttgacgccaagtgaaattgacgctttgaccaccaccgaagaggaaggggggactttaaatgagtaaatcaaaccaactattaaatatcgaggttgggacattcaaacggcaaggaaacaagttgatcctagagcttaatcacaatcaatttcgatatgaccagttgagtgagctaaacgaattaaagcaagctgatgccaatttcttgcagttggttaacgtggttgagcaagaccaaaaggtcgttttaacttataccttgccagataaggtcagatcattaaaggaattaccacatgaaaataaagcaatccggtcagcgattgccaaggaaatcatggcgcaacatgtggttaacgatagccagtatcacgttgcgttgaacccagctaacctgtggtattacccaatgcaacatgtttggtacgcctatcgcgccaatgaactcatgccttatgatgacaagcacagcaatttagctaaatacaaagcgctgattctattttgtttgacggggacaccctatgaacggctactaagcaatcctaaagaagccctagctaaacacccggacgactatttacaacaagtagctaaagctacgtcgttaaatgagttaacggaagtggttaacggcattgaggactttgtgagctatcacgaatggcaggaagttgaaacagcccagcagaaaaccaaacaacgtttatggttgagcgtggccggagtggcgattgtggccgttttggccgtcggcttagtccataaaagtgacgaaagaaagtatcaaagcttagctaaccagaaccaagcccaggtcacgcgattaaaatatagcggccaaattcaaactgctttaaatgatcggaagtggtcggaagcgcaaaaagatatgcaacgggccggctaccctgcaactaagcaagtcagtgtctttttaaagcatggtcagtaccagcaagctttaaaggttggcccaagccagttgaataaggttgtcaacacggcttatgccaacaaggatagcgggcaggttgccaagtgggaattgccaactaaggcgacaagcaagcaaaaagaccaattggcgctggaaaaagccatcgttaactacgacaccaatacgctcaataaccaattatcctttacgacgaacgctgatgttttattgagaatgggccaagccttcctagcccataacgatacgcaagacgcccagaccgtccaaacaaaattagctggggtgaacagccctaaagccaagtatctcaaagcgctattaagtctcaaagctgctaagaatgaagttagcgacgcccaaaagaagttagatgacgccaacaagattgatggcagtaaagataaggataaagacaagaaggtggattcggttaaggctgatctaaagaatgcgcagagcgaccaatcggcagcgcaaaaacaagttgatcaggccaagcacaaagtgggtgattaaatgcaggtattgtcgtttgaatataagaaaaagaagtggaagttgattgcttatattgtgggcggtgccattctgctaatcatcttgctgattgccgcggttactggtcagctacaagaaaacagttgtgataactcaaccaccacagagacgcaattagatagtaagagcatgacagaaaatgccaaaaatatctatgcgcactggaaacaaaaatatggtgcgaccccacaagcggccgccggtatcttgggggtcttacaactagaaagtcgccttgatcccaagtccgttaattccagttccggggccacgggcttagcccagtggttaggtggtcgaaaagataaactggaagatttagcccataaagaaaacaaaccagcgaccaatctcggggttcagttggactatctcgatcaagaattggacagtagttactatgcgtcaaacaagcagatctttaaatatacggacgtgcacaaagcgacgaaagcatggttaatggattatgaaggcatgagcaaaaacccggaacaatggtatttaagccaaagatacggttatgccgatcattggtattccgtgttcgggacgagtgatcccgtggccggtaatacgttagacaatgcaagttccggcgatctgaccgagttaggttgtgatagtgacccgagctattccggtggcagcattgttaaaaacgcggaaagtatgaagggcgacttctattatgttcaaacccaccctagccccgatttaggtagcgatttaaagaatcctaacaaaaccggtgggacagattgttcaggctttgtctggttagcgcttaataaagctggttacaaggtaccggataacatgggctggtttaccggcacgatggccagtgacgccaaaggtagccatcaatacttgaaacagatcagtgaaactgacgcgaaagccggcgatattgtgattgttaatcaaggcgccggggccggaaacaacgggcatatcgccattctattagataaatggcaaggtaaagccaccaagattattgagcaaggtggtacgggtgataaagttaacgaaagcacttttggggcagctttttatagcttactaaatggtggtgatataacgttagcccggccaatcaagaagtaaggagggaaaacaaatgaagcggagcatagttttaagtgtggtgattggcagcttgatcttagttatgtcattaggggcaaatgcctatcaacatagccaagttaagcaggcgcaacagcagattagtcgtctacaaaaacagaagcgccaagttaaccagcaattgactaaagccaaccaacaaaagcagttattgagcacccaaattgacagttataagacctaccaaaataataaagacaaaagtcaggctgaacttagctttaatacggtggtcaccaagttctttgaggtcatgaacaactttaagcccaagacctacggccagcgtaaagatggcgtgaaaggcttgatttccgacaagctatatcagcaatacttttcaaataaaggaacatatggtgatagcaatagtgtttcagctaagttaaaccaactgaacctgtatacgcaaagcaagcaggggcaaagcatgaaaggtttggcggttgttagctaccaaagtaagagtggcgacaacgactggcagaaggcaacggtactttatcaggtgactttcgataccaccacggatcgaatcactgcagtacaaaatttaggaagcagttttaaagccagtgaccttaattaagcgggttggtaaagccctagcgataatcgtggtggttttagccgttggcgggtttgccagtcatcaatatgtcaaccacgtagaaaagcagcgaccaatcgtgactttagctaagcaccctaaaaaagtgttgttcttctatcgcgatgattgcccggattgccaagctatttttcaccgaatctattggcacaacgtcattagccataacgttgtttttattaacatgaatcaatcgcagaatcggcattacattcagcaatatcaattaacgtcagtcccaaccttgatccatggcaagcaacggtacaccggcactaaccaaaaaaggattaaacagatagtaggtgattagatgaaagacaaattattaaacagcattaaagctagttggccgtatttactaacactaatctttggcttgtatttagcggagattttagctggctctgtcatggccttgtcgcgctataaactaacttttgcggatcatatgccaacggtgttaaaacaattagctttacacccctggcattattacaacttgtatttgggccaaaagaacccagtactaattattgtcagtgtcgccgtgatcctatacaccatctattttgccttgaaacgaagtagcaaacataaagcttgggaaactgcggacactgaaacccacgggagtgcgacctggggtgatctaaaagagttgagtgaccattactttagtatcaatgctaaagacctcaccacagcgtttaacaggagcactacaacagaaatattagaggcattaacaaaacaagaaacacaatccaagacagacaagtgaaaggaagtaagaagcatgaacagaccagatttattagtacgaatagttacgatcatcacgttgttaattgcaatagttttgtttctatttcagggttggaacacacctacttttgtatttacagttatcacagtcattttatctttcatttatcagttaatcagaatacagatgaaaaagaagtaaatcagaaaagtcatctaaagctaaccacattggaggtaaacgcatgaatgggacaattttaggaatcgtagataaacagattgtttaccaaaataacagtaccaaacccaatcggaatatctttgtggttgggggcccaggatcgtataagacccaatcagtcgtgattaccaacctgtttaacgagacagagaacagcattgttgtgaccgatcccaagggggaattatacgaaaagacggccggaatcaaactggcccagggttatcaagtacatgtcgtcaactttgccaatatggctcacagtgatcgctacaatccttttgattatattcaacgggatattcaagctgaaaccgtggcaacaaagatcgtgcaaagtgaaaatgccgaaggcaaaaaagacgtatggttcagtacccagcggcaacttttgaaagcattgatcctatttgtgatgaaccaccgtgcgcccgaccaaaggaacttggccggtgtaacgcaagtcttacaagaaaacgatgtggaggccgaggaaaagggcgcagatagtccgttagataccttgtttcttgatttaaccatgactgatccagcgagacgcgcttatgagttagggttcaaaaaggccaaaggcgaaatgaaggccagtattattgaaagcttgttggcgaccatctcgaagttcgttgacaaagaagtggctgattttaccagcttttcggattttgatttaaaagagattggcaacgacaaagttgtgctgtacgtgattatccccgtcatggataacacttatgaaagcttcatcaatctgtttttctcacaattatttgatgaattatataaattagcggccgatcatcacgctaaattgccccaccaagtcgattttatccttgatgaatttgtcaatttagggaagtttcccaagtatgaggagttcttagcgacgtgtcggggatatggcattggtgtgacgaccatttgtcagaccttaacccaactacaagccttgtatggcaaggataaggccgagagtatcttaggtaaccatgccgttaaactttgcttaaatgccgctaatgacgtgaccgctaaatactttagtgatctgttaggaaaatcaaccgtaaaagtggaaaccggtagtgagagtaccagtcatagcaaggaagaaagccacagcaagagcgatagttacagctatacgagccgttcgctcatgacgcccgatgaaattatgcgtatgcccgaagatcagagcttattaatctttagtaatgcccgaccagtcaaagctacaaaagcgttccagtttaaactatttccgggggctgatcatttggttaacttgtcacagaacgattatcaaggccaaccagaagccagccaggaaaccaactttaagaataaagtagaaaaatggaaagcaaaattaaaggagactgctcaaaaagaagtcgcaaacaagatgtctcagaaagaggaggagcaacaacaggacaacctagacagcgatttagagagagtttcaaataaagatagtcaaacagaggcgccagaagaagacgacaacaacttatttggataatggagggcatattaatgaaaaaatatcgcaaatatataatcgccgtgatgacagtgttactgattgttgttggtcttaccgcttgtgggaagtctacagcacaagatttgcaaagccatcagtggacatttgcttctagcaaagataatggtatggccgctactgcaaagttttcaaaaagcaacttaacacttacccaagcgggctttagcgaagtttatacttacaagttgattgaaaacaagggcaatgaacaaattaagttcattggtaaaaatagtgtttcaggtagcacagaaacacgtttgtttaagattaaaaagcagtcagacaaatataaactaacaccaattaacacactggctaaaagtgatactggtacggtctcactcattcccaaatagacaaaggaggattttaaaatgacagaaattattcaatcagctatttcacactttttcgaatggctactgtctggtttgttagatggtttattcaacatctgtaaggcaatcattgaccaagccaatcaaagcttgccgattgttaaaacgtggtatgccatcttcctgtcctttgcgacatcgttagtcgttgtggttgtccttgggcgtattgtgatgacaattataaaagaggcggacgaaagtaccgatgtgacttgggctaatatcatcatggacgggattaaatcagcggccgtgatcccggtcttcgtgttcttacagggctttattcaaggttcaattaccttgcccctgctaaagtatatgtttagttctgatcagcagttcactgctaaatcaattaccggcatgaataaagttcctgggttaaaagatgttggcatttcgctacctttacagattttgtttctgctaatcttcactgtcgtaaccgtcgtgttctttatcaaaatgtgtgtgtttgtggctgatatggcgtggtataacctgacaattcctttagctgcaatgagtatggcgaccgaaagctttgattacagtggcacgtggtggaagaagtacatttattacaatgcttctattattagccaggtgctttgtatgtcactatcagtatggtgtttcactaatatggctaaatacgggtttattgcttttattgcttcaatcggattcggctttctggtggtcaaaacgcctgacgcggttaaagacttttgggcttcaaccggtgtgactaagagtgctggtatgggtgccatgagaatgtttcaaaattatttccgtaaccactaggaggaaaaatagttatgaagaaaatcgcacactggctattggaaaaagccaaaaaagatatgcgaactgacccttttacaacaccttcccggcggactaagttgtcttactattttgataacttagttagcatgatcttctatttaatgggaacttacctcatgttaatggatttataccaagagcttttcacggcgaaccataccgattttttaggaactgcgctaatggccttagttttactgctgggtggcttattattccgttggtcagcctatgcagatctcaaagccatcaaccggtatcaacattatttgaagcaacaatcgatagagcaacaacaagaattgcgccatgaaacttggttgaaagcggctgaacaaggtaaaacagaattagatcaaaaacttaatcacaaggagtgaacgaacatgaccactgttatcttagctgaaaaacctagtcaagcccgttcatacgttcaagcctttcaaaagagcacaaaaaaacagggttactatacggttagcgaccctgttttgcccgaaaatacgcttgtcacgtatggtctcggacatttagttgaactagccacaccggataaatatgatcagaaatatcagcaatgggccttatctaatttaccgatttttcccgataaatacaagtttgtggtgtcagctagtaaaaaagatcaattcaaggtcgtcaaagacctgttaacgaaggccgataccattattgttgccactgatagtggtcgggaaggctctaatattgcgtggtcaatcatgatccaagcccagattgacgttaaaaagaagaccattaagcggctatggttgaatagtttggaaaaagacgccattattaccggctttaaaaatcttggtgactggcacaaagactatttggcttataaagaagcccaaacccgtcaaattagtgattggttgatcggtatgaatggtagtcccttatatactttgttattaagacaaaacggggtacgcggggtatactcaattggtcgcgtgcagacgccaaccttgtatatggtctatcaaagggaccaggcaatcaaaaactttaagccggaaccttattttgagctaaatgcggaaattttagctaatcagcaaaaatttgtcgcaaaattagacccttatcagcgatttaaagacgaagcagggctaatgacattcatgcaagctaaacacgttcagaaaggctcacagggtggtttaatcaaggacgtgcaaaagcaggctaaaaagagtgccagtccccaactattctcgctatccagtctgcaaagtgccatgaataaacgttatcacgccagcgccagccaaaccttagcagccattcaaagtttatatgaagccaagttgttgagttatccccgcaccgattgtgcttatatcactgatgaagaatttgagtacttagtggctaatctgacgaagtatctggggttagtctctaagcaagtcgctttaaccaataccaccccaaataaacgttacgtcaatgggaaaaaggttgaagaacattacgccattatcatgactaaagttgtgccgacgaaagagaaactagccagcttacctaaattacagcaacaggtctatgatttggttttaagaacgacgttagcgatgtttgctgatccttacgaatatgaagaaaccaccattgttacccaagtcggcgatgctaattttaaagcaacgggtaaggtcccaactaagcaaggttggcaagcattatttgatgaaaacaaagccgaccagcaagaagcagccaccctaccgctcgttcaccaaggcgatcaagtccaagcaaatctgcaaacaccgcaaaaagaaacgacaccaccggtaccctttaccgaaggtaccctgattacggccatgaagaccgccggcaaaacgcttgatgatgaagcagcccaagcgattcttaaagatgtgcaaggcattgggacaagtgcaacccgggccaatgtgctggaagtgttaaagaaacgcggctatctcgtcactgaaaagaacaagctacacgtcagtgaagccggaattactttatgtaaagcggttgaacttgagcccttgctaactagtccagaaatgacagctaaatgggagcaagcgttacagcaaatcagtaccgaagaacgcaccccggataactttttgagccaaattaagaagtttgtggctaaattgatcgctgatgttcccacgcaattgactggcagtgcagccattaagcaacaaatcaatcaccaacagcaagcacaaaagtccgccgaggtcttcttagaaacaccgcaagcgaccgttttaaataaacagaagttttatattgtaaagcctaagcaaggcgaagactttaccctgcccaagaaatggagcagtaagaccctcggtaagaccgcaattaaagcgttggtcaccaagggggaaaccagcaaactaaagggtttcaagagcaaaaagggaaagtcgtttgacgccaagttaaagcttgacggccataaattaagttttgattttgattagaacctgcctaccgccctatactacgttccggttggttaacccgtcatttaggttcacttttacaatcccaaaagtaaacctgaacaacgggtgagattaacaaagcaaaggagatcataaaatgaacaacgaattagcagttttagccagtgaattacccgttttgcaagctaaaggaacctacaagtatttaaaagaaatcactggtaacggcgcttattatcaagtagcctggcaaaaattgtctgacggttacgttgccctttatggcacgaccccgattcaaataagatcattgccaacattgaatgatatttttgaagatgaggaggggtaacttatgccaaataaagcagatgtgaaggcttggaaagcacaattagtcgcccaggctgaacagcaaatcctaaaattaactgatagtgaccaatttaaaaagtatctcaataccctggctaaatttcatcgttatagcgccagaaacattgatttaatttatgcgcaaaatcctcaagccactcaagtcgccggttttaagcaatggcagaaggattttaaccgcaccgtcaaccggggcgcaaaagcgattcggattgcggctccgatcattaagaagctaacaccagccgagcagaagcatcttgataccaccgatgagcgcgccattgtcggttatcgctatctacccgtctttgatgtggcacaaactagcggtgaaccagtgttaagtgctaaagactttgtcaaagaaaatttggccgatcatcagaatgtgacaagcttatataacgcgttcaaggattatttaaaccagcaaaccgaccttaaagtcagtgaagtgcctttagcgacgctaaatggggctaagggatattttcaacccagcactaatgaaatcgtcattggtggcgatgagcccgacaatgctttgaaactaaagacgttataccacgaatatgcgcatagccagctacacggcttaaaatcagcctttaaagatcggccacgagcctatcaggaaacccaagccgaagcggttgcgtatgttgccatgcaaaatattggcgttgataccagcaactactccctcggttacgtggccacctgggctaaagataaagccgtgatccatagtgctttaagtgagatccagcaagttagcaacaaagtgattgagcttagtgacgggttaaccaaacaattaggcttacaagaagcccaaaaagaacctgagcatgatctaaaaaagctatcagcccatgatcttaataagtcctaccaaggcttgcaacaacaagttcagcaagcaactaatccacaacaaaaatcagaactacaaaataaattaaatgatgtacaccaggaaatcagtaatcgaactcaaaaacaactgaaagtatttgctgaacagcatccagaaatcaaacaaccagattctgaacctgatcaaagtctaaaacgttagccagtttttaaaggtcatgctataatgtaatagaaaagggaagccttgcgctaacaagacttcccatgcaagccgcttcaaaggcggtggcagaaatttaataaacgattttagctcgtcctgtgacctctaccaaagttacacagggcggctttttttatttgtgatgcttgtcgatatagctgaggagcgcgattaaaaacgtgccaaacagcaacatcaactggaatgtttataattgattcaagaaaatctaaaaacgatttttttcagtgatcgaatattaacagactaagcttagaactgtgtctttagtgctcacttttgtatgctaacctaaagtttaacaagtgttgccacttccgacccagatgttttgaacagaacattaggttgtaaacgtggtgttggtgaaatgtagtcgtatggctcccctgcaaaagttttaagcactgccattaggatatggcgcataccagcaggtggaatcgccataccaatttgtttccgcacagattctttaccaccaatgaagtgataattatcaggaaaggtttgcagtcgtgcacgttcacggttggttaatgctcggttttccttccagtgatacatatgggtaccaccgcctccagatccggtaacagtatatgacggcttattacggtctaggcgcttatagatatttgaaagccgagctcccttgacgtttagacgcagactttcaggaatttggtgcgaccaagcattaccaccttctgggatataggacaacatctcaatagtcgaagccttgtgacgtgttaattcgttattaaacgcgtctgctggaatcggtggattagttagagcctcgccagcggtaacatagtcatctggattgggtgtggtcggggcaggtacgtgaaatttaatgccttgaatagccagatcattgcgaataccaacaattaatatacgatgccgggcctgtggaacaccgtattcctcaaacttatagaagtttggcgttagtgtgtaaccaacatcggctaatgatttgagaatttgaatgaaagcatcaccgtcgttggcagaggttaggccaccgacgttttcggcgataaaaacctttggttgaaactcctttaatgttttaactccgtaagtatatagtggaccatatgttccatctaaccccttttgcttgccgacaacggaaaaatcattgcaagggaatccgaaaatcaacgcatccatatcagtcagtaattggtgattagtgagatctaatttccttacatcttcgcagtaaacggtagtcgccttagggttattaaggatgttcagtttataggtatcaacagtatctttatcaaattcatttgcccaggcatgttgatacccccattttctgcccttagtatcgataaagtgtgaagttttagcagcatatgcgccaccaccaggtccagcgaataattcagcagttctaaatatcatagtgaacacctccatgagttcagcatatcgaacaagtgttttagcatatgcctatgctaaaaatcatacgactttttattacatattgcaagctctaatagtcgtgattaatctgctttagtgtgggaaaatggagaataataggaggactaaaaatgacaattttatactctaaagtaccaccgatgccatttggggagagcttaccacttatttctaatcagttggtaaaagaggcgagttcagcttcgagaattgacattgcagtaggctatgtttctgtagatggattggataaactggactcattagtttcaaaggggaacattaagcagatctgtctggttgttggtatgtatctggaaagtggtattccagaaagtatctataatcgggtacgtttgttacataataaatggcaagctacaggtaaaggcgaaatccgctttgtgaacaatatgagctatcatggcaaggtttatctcttttggcaaccgaaccaacaaggaaatgatgatttgaagtcagcggtattaggatcagctaatttaagcgtgctggccccgttgggatctgttgctcgtcaatatgaactagcaaccacaattaccaattctaaccaactgcatgaattgtctactcatattgagaaattgaaaaccagctgcaccgtttctgccaccaatttaaacgatttcaaggtaatccacgagcggatcgaagtgcttggcgggatcgaagaagttttggaaacgaccgaaagtgaacaagatatgtatcgttcactgcagactgatattgagattaggattccaattaaagcaccattagctactaatcgtttttctaccgcccggcatgattacgcgcgatcaaatatcaatgtggcctatggcggcggtcggtataacaaattgagtggtggtgttgatcccagaaattggtatgaggttcaaattaccgtaaataagacgatctctactcagccaaactaccctaaaaataagcctttttggattgtaacggacgatggttataaatttgaagcgcataccactgctgataacaataaacaactgacggcttatggtaagactggtaacgatcgcgtttttgggcgctggatcaagggacgattggctacagctggatacgtcaaaccagtcgataatacagccgccgatacggaacgtctcggcgttgtaacgcaagaaatgttaaacgctgcccaaatgcgcgtgatggttcttactaagacatctacacaggaatatggggtggtattcaatcgattagctccaacaccacgaaataagaaaggtgctttagacaagaaacattggacacgggaattgctagacgtctggacagttcactttgaaggtgagaaaagctaatgggatatcttaataattacctacaacaatttcgtgatgcaggtaaagatgagcttgcaaacagcatagaaaaaacgtctcgacgtataggcaaaaaatacatcagccatttcacctatataacacatgaaatgggattgctttttggcaatattcaaagtgggaagacgggacaaacatttggcattatctgtgaagctgctgatttggaatttcgctacttcctactgatgacaacggacagcaaactcctacaaaaacaaacacttgaacgcgcacaacatgatttgcctgaatttgcaatctgtagcgagaatgatgaagaaaagttcagaagcgcaaaaaatcagccggtactaattattgtaaaaaagaatacacgtgttttacaggcatgggttgatcgattccgtaattctcaaaaactgaagggaaatgcattattcatcgttgatgatgaagctgatgctgcttcagaaaatacaaaggttaatcaaaaaaaggtttccgcgatcaatgatcgactacgaaaaatacgtgatacagcacaagcatcaatttatcttcaagtgactggtactccccaagccctgctacttcaaagtcttaactccaattggcggccaatgtttactgaatactttgaacctggtaatggctatctcggtggtgactttttctttccgggaacagagactaacgatatacctaacttcattcattttgttgatgatgaaacaccgcaagaaagcgcaaagcatgttgtgctccgccacttggtcgtatcagcacaaatattgctaactggtggtaaagtctcaaactgtttagttcaccctggcattcgacgagcagctcacgagaagtcaaaaaaagaaattgaagatgcaattgcctggtggacttaccatcatgctgacgaaaaattcactgatgcatttgatcgggagtatgccgctattacaccacaaaatactgagaaacaaccacacgatcaagtattgacacgtgttaaacagattcttgaaaaacgtgagtttacgattgtcctattaaacggaacatcaattgacgatgacaaagactatgagtctggatgtaactttgttattgggggaactaacctgggccggggtgtaacctttggccaattgaatacgttctactacaccaggaccagcaaaaatccaaatgcggatacgatgtggcaacataatcgcatgtttggctatgatcgtgaccctggcttgataacaatgtatagtagccgggcgttgtataaactttttgcagaaatcaatgagactaataactcgattatccgtcaagctcaagcaggaaagaagattacaattgcatatccagatggtttgaatccaacgcgatctaatgtgttagataaatctttgctgaatatcctggttggcggatcaaaccactttccaagcgtaccgaagaacgaaacgactacgcaaatatcagatttggttcaacaattttctaatgatgatccagctactgaagttagcctaaaatttatatcggatattttgaagcatttcaaagcagaaaaagagtttaatcttgatggttacatcaaaatgattgatagtgcccgtagtgagaatccgatggcaagcgcccatattcttgtcaggcgtaatcgtgccgtgacactgggaaaccgtgcattgctgtcaccaaacgactggaaagaaactaatcaattccaagacgagttcgtattaacactgtacaaagtctctggagagaagaacaatggtaagtcagtgtgggtaccgaatattaagttaccgatgaaaaagaacttttatattatttaaattgtaattttaatataacgaaagttctttattcggcatcgaaagaaagcccaatgtaaaataatcaatggcacttttgacttttaaaaaaaagaggttgggtatcatgaatgacagtcaaaaatttttagataaagtagaagggaaaaatatagattttttaattggttctggtgcaagttctgattatataagcactctttctgttggggaaaaagggaataaacacagtattgaagaccttttaactgcctataattctcaaaaaatggcacaagcttttttgaaattccttttttttgattcatcagtcaaaaatggattagttagcactactcacattccagaagaagcaatggatactctgaactcttataaagaattaattgagaatatgcttactctttcgcgccacaacggatttgaaagacctaaaagaactaatatttttactacaaactatgatacatttttcgaggccgcttttgatgatatttctcttgaacaccccttagccttttttaacgatggctctagaggtttctttacgcgtgaagttagttacgaaaactattattttaatgttacccacagtggatccattgacacatttcgtagagagataccgtctattaatctgtataaattacatggctctctttcatggtcaaaaaaagttttgaaagatgaccaaaccattattacatcaagcctagaaaatgaattactaacgaaaataaaagaagaatcagatactattttaaagatgttgaatcaaggaaatagaattgaagtaactgacgaaaacgttattgaccaatatcttagcaatatagaaagaaatgaagaactaaaagatgaactcggaatatttgaaaacgattattccaagctattaattgtgagtcctaccaaaagaaaatttcaagagacagtgtttcagaaacaatactatcaactactaagagaattcgaaaatgagttgcaaaaggataacactgttttaatttgttttggtttttccttcaaagatgaacatattttagatctgttaaaaagatctatttccaatccatctttacagattttcgttattccatatagtgaaaaagacgttgactatattaatcttgtgttaaaaggatatactgatgtgacatttttaaagtcccctgatactaacgagccaggtaacttcaatgtcctaaataaatttttagaaggagcctatggacaatgaaaacagctaagatggatccgttaccaagtgtcggaatcgtaactgaagtaaaggggacttacgttacagctagaatgtttgaaaatactaataatttaacatattacagaaacggggttacatataggggagtgggtactggagaatacattggaattcaaagaggcccctataaattagtaggcaaggtccttcacgaatatttagaagacacgcaaaaagacagtaatgatcaggaattttcaaaaaacagatttattagagaagtggatatttcaatcataggagcctttaggcaaagtaaattcacttttggaatttctatttttcctcaaatattttctgaaatcgtattactaagttcagaagaaacccttcagatactaacgggaaatattctcaatatagattatccattatatattggaaaaacagtccccgaaggacttaaatatgcaattgattggtcgcatatctttaacacgcattttgcaatttttggtaacactggcagtggaaaatctaacaccttggcaaaaatgtattcagaattatttaatactgctgataaaaataattggaatattaataattccaagtttatttttatagattttaatggtgaatacactggtgatgaatcgttaacatcaagcaaaaaaactattgaacttaatacttcatctacatctaaaggagacaaaataatccttcctagatcagaattctgggatatagaaatgttgtcagtgttgttttcagcaacgcaacaaacgcaagaaccctttcttagaacaactttaaagcattttaatcccgggaaaaataaagttacaaagaaagaaataataagttacgttgtaaccgccttttgtcaggtatttcaaaacaatgtgcaagacccaagaacgttaaatttacttaaagtaattttaaatgacttacaaattaaaataccagaaagttccgaacttagcatttggttaaaagcatcatggaacagcaatagtggcacatatttttctaatattgatactacttatacgggtctattttggagttttactagcaatggcaaaatctattttaataatatggtcaataaatcagaatttagatatttgatagaagaaactctaaattgggaggatgtcatgattgatactgattggcaacctctaactttgttatctgtgtttgtccatctacaaatgatttataaattaacctacggaggagctcaatttgatttcattgctcctttattaaacagaattgaagcaaaatcaaagatgtttaataagttaattaaagtaagcaatgacgactcggataatttttctgagaaatattgcacaataatttctttacgtaatgtcaataaagacgctaaagcaacaattccattattaattgcaaggtatctttataagcttcaaaaaaaagacttattaggagaagatgaaattactaagactactaaccttataatcgacgaagcccataacattctttctgtaaacagaaatcgagaaggtgataaatggcgagattatcgtttagatgtgtttgaagaaattattaaagaaggcaggaaatttggcttctttttaactattgctagtcagcgtcccgctgacatttcagcaactattgtttctcagatgcataattttattattcatcgtcttgtaaatgaagttgatttgaatatgttaggcaatacattgaattcattggatagtgtttcaaaatctgctatcccttctctagcccctggaagtgctatctttacaggaaccagctttccgctccctgtaatggttcatatagatcaattagataagggacatgctcccagtagtgataatgctaatttaaaaaaaatctggttaccacatgaccatcaaaaatgattttttgttttacgggtcataactttaaaaatccagcctctaaaaaatcatcaggatggtatttaaatggtcacggttccacttttcttgtaatcgctaaaataataactctttaaggttctggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagctacgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcaacccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctcacactgtttgcaccagatccgccgagatcacacttcccgactcaaaaatccgggcattcgtcattccgaccgatgaagaattgatgatcgctcgcgatgtagaacatttcaaaaaattaggtaaataagcgctaaaacagatgacacatgcgatcgacccgcttttgcgggtcggttttttttatgcaaaagagttattatttgcacaataagtccatccactttacgatgggttggtagataacttaaggaatttataaagaaaacgaggaggaagaagaaaatggacaagatcaacaagaatgatgaaaagcagctggaacatttaggtgcctttgaaatcagcaataaaatgctgtcattggcacaaaaaagcgaaaaaaataatatctttttgaatgctggccgcggaaacccgaactggatcaataaaaaagcccgtttggctttcactcgcatcgttgaatttggggtccttgaatcagaacgcacaatgaaagacggcgatttagccggatataccgaaaaagacgggatccgcgaacgttttgaaacattcctcgatccagataaaaacgaaaccgatcaatttttgatgaacgtcttgagttatatcaaagacgaactgcatttggaccgcgatgaagtcgtaaaagaatttgtggatggcgtcatcggcaataattatccggtcccaagccgcatcctgaaaaattccgaaacgatcatcaatcattatctgcaatctgtcttgtatcacggagaagatttggaaaatgaaacgcaattgttcccaacagaaggcgggactgcagcgatcgtttatattttcaattcgctgaaagaaaacaaattgatcaaaccgggcgacaagatcgcgctcaacacgccgatctttacgccgtacatccaaatcccagccttgaacgactatgaaatggtcgaaatcgacttgggctcgaaagaagaaaataattgggaagtttcgccgaaagagatcgacaaattacaggatcccgatatcaaagctttcttcattgtcaatccaagcaacccaggctccaaagcatttgaccaaaaagcactgaatgaaatcaaaaaagccgttgcgaagaatccgaacttgatgatcattactgatgatgtttacggaacgttcgttgacgatttccaaacagtttacagtgtcgcaccgaaaaatactttgcttgtttattcttactcgaaactctttggagcgaccggctggcgcttaggggtgatcggtgtcagcaaggacaatgtctttgataaattgatcgcggcacttccgcaagcagataaacaagcactcgaaaaacgttacagtcttgttgttttggaacccgaaaagatgaaattcatcgaccggatggtagcggattcccgttcgatcggcttgtatcatacttctggcttgtcaacaccgcagcagatcatggaagtcctcttcagcttgacgcatttggttgagaagacgaaaaacgatccgtatatcgcagcttcgaacaaattgatcgataaacgctacgacgacttgcataaagccttgacgtatccggaagacaacagcgaaacttctgcgaaatattattcgatcatcgatatttacgaattggctgaaaagcgtcacggcaaagcgttccgcgaatacttggcagacaacttcgaacaagtcgacttcttgctgaaattggctgagaagaacggcgttgtattgatggatggtgtcgggttcggtgcagcacctggcgatttgcgggtttctgaggcgaacctgccgacggaagattatcgcttgatcggccgtcaagtgctggaactgcttgatgaatattataaaacgtttgaagcacaaaaataggggtggatagtgatgaaagcaattgtggattatttgcttgccaatccgatcattccggtatttcttagtctgagcctaggctatctgctggggcgtttcaagatcaaaagcttctccgtcggttcgacggtcggggtcttgatcattgcgcttattatcggtcaaatcggagcttttaagatcgatccgcttgtcaaaagcattttcttcgatctctttatctttacgatcggctatgaagtcggaccttcatttattcgcagtttgaagagtaccggacttaagatcgttggccaaagtgtcttcttcgcggtagttgcgtttgcgatcgcgatggtcttgtttaaactattcaaagtcgaccttggcgaagcggctgggatcatcgccggcgctttaacgcagtcggcggtcatcgggactgccaactcgtcgatcaatggtcttgatatttcttcagctgctaaggcagcctacaactcggaagtcgcgatcgcatatgctttgacctatgttttcgggaccgtcggggtgctggtcttcttgaagaatatcgcgccagcgatcctgcacgtcgatttgaaagaagaaacgaaaaaattggcagaaaaactcaacttcacttccggaagtttttcgccattgactagttctgtgcgggtcagaggatttttgctgggagacgattctccgattgtcggcaaaaagatcttgcaaatcgaaaaacaatatcactatgaatttgttgttgaggatgtgctgcgcaaggaagaaagcatcccggcaaccagcgacttggtcctttcgccaggcgacgagatcgtggtcgtgggcaatatggaagaatttttacagttggaacaaagtcatggaacgaccgaagtttcaaacaaacagtatcgtaatatccaattgaaaacgatcaatgtgatgttgacgaatgcttttaatttccatgctttgcaagatatggtcaagagcggcttgatgatcacctccgtcgaacgcgacggcaaaaaagtgaccgatctgacaacgatgcgcagcggtgaccgcttgacgattatcggaactccgcgggcactgcaaaagatcttgccagaaatcggctatgagatcgctgaaggacaaacgaccgatatcagcttcttgactatcgggatcgttctcggggttctcttgggatcgatcgtggtcaaagctttcaatatcccgatcacactcggtgaaggcggcggcgcacttttcttggggctcttcttcggatggtatcaagaaaaacacgccaacatcggcaatatccccggacccgtccgctgggtcttcaagagtctcggtttgaacttgttcatcgcggtagtcgggctgcaagccggctcagactttgtcagcgccctagtgaagatgggctggaaagtattgatcatcggggcgatcatctcgatccttccgcatttcatcacattgctgttcggtcgatatgtcttgaagctgaacgcgatcgataatatcggctccttgactggggcgggtacgatcaccgctgctttgaacgcgatcaatgaagaaaccggcagcagtttgttcgccctcagttatacaccagggtatgcagtcggcaatatcctcttgacgatcctcggaccgttgacagttgcgcttttgagttaggcaaggcgcaaaatcataaataaagaggttgagacaaaagtgtccagcttcaagaaataagaagaaaaatccgaaaatagtttctcatatttttgagatttttcggcttatttccgaagaagctgcttttgaaacaccgtttattcggaaaaagaggctgggacatgacttttgtcccagcctcttttttatggttctataatatttagtgttggtggaaaatccttcgggtttttcttccagcactcttttttattcttgaggatagaaatagagatatccaaactgataaaatgtagtcgacgaaaaccaacagtcatcaggaaaggatatctccatggatcatcatactagaaaacttttaggtttcacagataaaaatctctctttcagcgagaattggctgaccgaacgaactcacgctgatagaacttgttcaattgttcctcggcaatttgctggcttggtaacggatcagtggctaatttgacgcgaccattttcacttgtggctaagtagtattctttttcagactgaccaagttcttgcgtttccaaaacatgtagattatgttcataacgtcctaatgcgttatcaacttccaacccataaaaaccaagaaagctttttagaaggctttcttggtttttatgggaaggcggaaaatctgtcgatacttcgatgggtttcacgccgcttgccggcgtaacgatggggactcgttcaggcgacgtcgatgcttcccttttgccttatttgatggatcaccttgggatgacggatgttcataaaatgatcgtcatcctgaacacaaaatccgggatcctcggtttgtccggaatctccagcgatatgcgcgatatcgaagctgctgtcaaagaagataacaaggccgcggaactggcgcttgaaatctattgcgaccggatccgcaaatatatcgctcagtatatttctgttatgaatggggtcgacgcgatcgtattcacagccggtgtaggcgaaaatgatactgggatgcgcgaacgcgttttgaaaccgatgacttggttcgggatcgattttgatgttgaaaccaataacaagatccacgggaaagaagccgagatggttctggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagctacgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcaacccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctcacactgtttgcaccagatccctctttaatatttctgttttttgacaaatatctgattcaataaattcactgctggcctgtgcaaccatacaatacttaaagtaaaggaggcacctttattgagggggagcgacgtaatgaagcttcgtttggatgggggcaacaaataacagcgtaaaacggccattagggtatatcctagtggtcttacttgtctgcacgagctgcttcaatttgcaagagttcaatagcattgtccaaaattatcaatcaactagcaaacagaggaccttaagcaaaactactgaacattgcttaaggccctctgtttgctacgtattatctaagtttatgcattgtttctgccataatccaatgaatgaattttaaattactgatgaagaatataaacattatgactacaacgataatccattcccatagcggagcttttgttaatgtgactaagctgtataagtaaaaaattgttatgggtaattcaataattgcggttatagctccaggaacataagcacgtttattaaagacaaaaactaagtgcatgatcaaatgaaacagatacggtaaaattgcagtggcaactagtaatggtgatcccatgatataggcgactgctgcgagcagtaaataaatacaaaattcttcccagattccagccgctaaaatatctgaacgattcactccaccaaacagcacacgcccgttaattttgggattatgatctttcaaccaatatgggacaaatactaactcttcaaaatcatggaacataaataacaatggcaatatccaataagaactaaaattaatcattttatggccctcccgctagtattatattatgttgatgcgaatctttgaatataatggaaacatgtgccactgaaaggagtttttgtgccatgtctcggaaaatgattattgaagagtctaaaaatgcttttattgaggccttgtttcaactactgaaaagcgaatcctttgaacatattacagtcaaacagttgacattagaatcgggttattccaaaaggacttattatcgatacttcaaaactaaaacaaaaattttagatatagcattttgtaaatatctcactagctatcatgattacttactaaaatcttccattacaccggatactatccctaaacattttcttgaatttatttggccccaccatgacaaaattgaattgctagctaaaaatgatctcttagttcctttgctaacaagacatattcaaaccattgtagcgcttctcctgaatgtaaatgtcccttggcgaaaaggcagtttgaataaccagcattatgagtacatgctaacgtactcaattggtgggttcggtgttctactggatacgctttttaagaagagtgctcccttatctccagatcaaattagcaaagctttaagcatggcattgaaagagattgctatccaagttgatatgaaataatataaaaaataccatacgttcaggatttctaactgacatttagcctctataactatatggtagattgtaaaattaatccgaacagcgtcggattaattttacaatctaccaattgcatgagtacaaaaggttggtagcaattaaaaaatgttcgataaataaggcggagtagcccgttaaggactactttttttggctataataatcatatactgcaaacaggaggtggcttgtattgactaaaagggagttattagtcccagaaatcacgacagaactaggggctcactgacaacgtgtgtatcgctcgataaaaggttgaggaatgtcaattactacggcgagcctactatcaagctggatagagagcattttattgtggtaggcatgtcgcggagatacaggtgccaaaaacgcgagtgagatagaaaaaaggtgtaaatgcttgatataaagccaaagcaagtcgatacaaagaagcgcatgtcagtacaaatgatacaggagaaaactgacaaagcattacagataaagagtttaagcaaggtagtgttgcagtacaaaaagtactggcggccaagggtcaacaaataaactagcacaacggggacttgaattttaattttttagggatacaataaaattatattgataagaggtgaatttaaatgaacaaatatgtcgaacttgatttagaacaattgcaacaaatctcaggcggtatgagtaaaaagcaatggtatcgtttaggagaacgtgtcggtcgtgtagcagtttttatcggtggaggattactttttaaataaaaatttttgcgtttctatactggtatgtgttatcgagaggtcggattctttatgaaaaaattaaaatcatttgaggtgctttctgatgaggaggctaaattgataattggcggcggacattgctatacggcggggtgtattcggcgtagagataagcctcggaattcagatagcttttttccgggattagcacatggtatttgtcaaggagttggtatttgcggatgaaaccccttttttataaaaaaccatcgttttatgtgtttattttattttcactgttcttaggtatttcattggtatatcggagagattggtggattacaatccctcttgtactagtagttttaatacaaggatatagaacaattagataatcataaatataagttgctcttggtttcataggaatcccaaaagtatagtaaaaatggtacggtccgttactgaaattagtgattgtaatatttttaccatgctttttatatttatttaatgtatgtctgcaagttactttgatacggtgtagacgtgattctgtgaatggacgctaaaaatatgaccaattttttattgtaatctcttattgataatgaaagtgtcgatgtccagaaaactatagcagtacaagggaaggtttattatgaatcttagcaagaataataaggtgtggtatcttatttcgtgtttatttctgggacttctatttttagaaatccccacacagtcagtaaatgctagtacaagtaaaaaaccagaagaatccgatacagtaataacggtagttcagtataaaaaaaatatattaaaatcgaataaagtaggtgtttcgggtttatataaacttataacgaaaaagggtaatcatccattctacttattttttggctctgaggagtgtcaatattgtcgaaagttttcggtaacgttgaagaaatttatggcacaaaagagcactcaacctgtctattatgtagatgtaaataaatttggtgtgaacgctgattcgcatagtgttacttcgaaaaaagtcatttcatttattaatgatagagttaatctacattcaataccgacaattgttgccgttaataatacacacatcataaaaatatatcatgattcaaatactacacttaaacagttgacagaactaaacaagcgactaatttcaaaataggttgtaaaaatgaaaaagtgctctaagagtaaattaaagttgcttgtactgagttctaaaagatgaaaattagctttcgaaaatggagttacggtcagccccatttccaagaaagctttttttgaatcaattatcagcaaaatttaattccattatttgcacgttggcaggaggtggggacaatgtaaatacatacgaatttttgtgccaaatttaatgtataatcgcctcggaatattcatacggaaggtaacggtagaaactaaaacctgaacattaatcttcttcaactacttcagagagatacgttctgttaatctaacttatctatatgttgagattgtaaaaaagaaagttttttggtaacaatgttgaaggggtgatcaatggttattggctatacacaggtttctaagaatggtcaaaaattaaatcaccaaattgaccaactgttaacttatggcgacaacgacccgaattcgaccagttattaccactaattcgagcaaacgacgtcgtggttgtcgaaagtatttctcgtctcggacgcaacacgctcgatattttaaatcttatccaactgctccatcaaagacaggtcaagtttgtctccttaaaagaaaatatgggcacggcaaccgttacccgccgggcaatactacaaatgatgagtgtaaatgcggaattggaatgtaatttactggctatcgctttaaggaagggattgccgtagttggccacgggtgccacaagagaaaatgaagatcgctattcgaatgtaccggagtaatgagtattcggtgaaaaagattctggcagccaatcagatctcgactgggactttttattgtgaagtgaatcgcttgaagctcaaaaattttaagtaaaaagatgaacagtaagcgtaagtgatcttatgattattcgtcttcctaccgcgaccttttcgtatagatgttccattgacctcattaagggaaagcttatgataaaagttaacatcctatcacggactagttgcaactggtctttattgctgatatttatttttttatttacccggcgaatagatagattttaaaatacatcatcgttgaaattacaacggttatttataattggtagggggagtacaagtatgcattggagaaactatgttgcgcaagttgacgagatggactgtggggtcgcagctttagcaatgattttgaaaaattatggttc

SEQ ID NO: 18 - DNA, 36436 bp, synthetic construct
  source 1..36436: mol_type = other DNA; note = Lactobacillus plantarum PDG8 - contig 18
agatcagctcctaaaagatgggtttgtggtaaacaccattttaaaggaagctgatcttttttgtccgaacagcgttcggattaattttacaatctaccacacaaccaaaaagccactcatctcatcacgaggtgggtggcttttttgagtaagttaagtgacagcattgattgttatatgattgtgtatgtcctaaatggacacaagcaacgctcctaagcaaagcctgtatgtaatgatttcagaaaagccctctattccgcataatagaggacttttttgtgtgcattctgcttaatttaaacggacaagtatacatctaaaaggtgaacgtgtcgtctgagagcacgtgattatttactttttactttgttagcatcgccggtttccaaagtctgtatttgagtcgtaagcgtattttgttcagactcagttaacgattcaaaaaaagttttttgtaattgggctaatccgttttgttgagttgagctataccctaaaattaccatagctttcataaagttttttagatgattgtcaattctgagcgtagtatcaaaagtaacaccatctatttgtttagacttcgttttgtttgattcgtttagagaagatatggaaatttctttttggggctggggcgccgattttctaggaattattttgcttttatttgagttaggattgtgtaaaagttccaccatgctagtccgccctttcaataatttcttgtgccacagaatcgtataatctaattatttttttatcgaactgatcttttagaaatacacctctgattgaatatcttttgattctttccatattacgaattagggtttttaacatgttttctttcccaaattcttcttctgctacttctaatgtgctgtgatcaacaggcgccccattctttaatagcacaggaagtataccgagtaaattcaaactaggtgcttcgtattcatcgattacctgttcctgtatatattttagaaacgattcggcaccctgaagactgtgctcttgagtttgaaggataatcagaacccaatctgaagcgtataaggcgctatcagaaattaaggaaatagtcggtggcaaatcaaataccacaaaatcatatttttcttttagtgaagcaagtagcttgctaaaatatgtaactctatctttataattatttttaaactttttttccataatccgtgggtacaatgaaaaatctgcgcttgatggaataaagtcaatgtttttatccaaagtaaccaacgatcttgataagtcctcttcttggattgatgcaagcaaggtttgattaaatttaatatcatcgtggcctaaattagccgcggttttaaagtaaatatctgtagcgtttgcttgaggatcgaaatcaattaatagcgtttttttaccagcacgagctagtgccaggcatgcaagcgtggcatttgttgttttaccggtgccacctttaaaatttccaaaagtaattacttcacccattatactgacctccaattaagtatcctaatatacaaggatacttggatacaaggatgataacatacaaagatacttggatacaaggatacaaggatacatttcttctcaaaagccgttaaattaagattgactgcaagtatcctaatatacttagatacaaggatacaaggatacttagatacaaggatatgaatatacaaggatacaaggatacaaggatacataaaaagaaatgttgatttatcaccaaacaacgagtaatattggttacataaaatagaacataaaaaaacacccaccgacgggaatcggtgagcgccacacaaaagtcaactcatttactgactattatatcatggccggtgcgatttttaaagccctaggggacaagctggggtctaaatccaaggggacacgtttgccagggcgacttcaataagtctggctataccacaacaaggtcatctgtacggctgggtggtgaatggtgagcgcgaccattaacggcgcgggtggtaaaacgaagcttcggcttggtgccactgattagttggtgatcgaacaaacataaatacgtattgccaacgcctactagggcgttttttagtaggttaaaccgaaaacgtaggtttataatgagtggtggtagcaataccgcaattgtacagacaagcgacgggcgttaacgaccgacgaactaaggggaaacttttagtagtagaattgtactctggttcagttattccaaatagctgattccagggaacaattctgcgctcaaaacgtcactccctctaaactgaatggaaaaccgtagaccgtcaagtcaaattccaaagaaaaaaagaaagttggtggaattgttggaatgtaaggattacattgttccattgaatccagatgtgatcgttaagaagacaatctatcggagttctgcaagaattactgagcgacaaaggaaccaagtgaagagagttttgcgtagtcaagggtatcagggaagaattagtagtattcgatacactcgagtaaattacaagtattcctttaaagtatccgtgaagtatcggggaagtgttggcaaatttttggttaatacaaagaatgagacagttgaatttaagggaatggtctaggagtaatcccagtgaatttcacaaactcattttccccaattaaggccaatctgcaacctataccacttcttttttgggcaagttcacaaagataaaataacggaatgtggaagtgccagggcgtgatgaggttacttgggataagccgccttatgtgaagtagaaattggtatactaaaaaaggctcccggtttaacactggaggccttttttctaggttacatattttgaggatgaatgtttttatcttcgtagcttttacttgggtgctgtaacatgatgaatactgcttagtttttggtgccgtaccccgcaacagatgcgtcgcttcgttggtattatcttaaatgctaagtaccgagttgagaaggatcataaagatattggcgtcataatcccactggacgacgaagaacttaaatttttaatgactaaagccttgagacgttactttaacgccctaagaagcaatgagaagcacatcaagaacgtggaaaactacctgtacggcaccatgcaaaatctatttggtgtttggtggaataaacaagcggctagagaatacgcggccaaacaccccgaagaagaaaagctggccgacaacgacaacagtgggttgtactactagtcctaaaaggctgcaaaatcctttctaagcggttttaatacttactaacctttatacttaaattagatttaaatggcttaaacagaagaacaggggcttttaaataagtggcagagctaactagctcaaaagttcagcctttagatcaatgccaacctcaagtggtctgaggccagggttttatccattgatcagatactcaaaaggtagtataatggtagtagcaaaagaaaggggatgagacaatcatggcagttaaggaaaagaaacgggtccaagtcaagattgataaagatttggccgatgataccgaagcagttttaagcgaattgggcttaaatccaaccacggccattaacatgttttacaagcggattgttgctaatggtgctttaccttttaatgtgtctttaagcgaagaagaaagagctaatttacgctttttaaaggcgaccgaagggacaccagtcaccgagttcaaagacgctaaagaggtcgctgattggttcaacgatccagatgaggactaatgacttagtcagcctatacgttagttttgtagaaactaacggtggcaagtctcgaccagttttaattcgtcgggtatcagaacagacggtcgaggcttttaaaattaccagtcagtatgaaaagaagtcggcttatatcaagcaacaatattatccgattcaagattggcaatccgctgggttgaagaaaccttcctgggtcgatcttagtaatatttatcgctttcccaaagccggtttaaactttaaagaaatcggtcatttaagtaagctagatcaaaataaaatttcagattttacgcttgacctaaaatcaaaaagaagaggtaagggtcaaaagataattcaacagcgatcaagtaaaaggaagcacaaagaattcaaaaacagttaaaagactttgctaagaagctgtctaaaatctcttaagaagctgtttagtatctttgattttgacccaataatttgataaactactgtcaaaaaagttggtgatcatatgcaacattttagtcatcattaccaaagcgatatttctcggcaacaattcgatttgatccgtcaggatctgaaagcttcaagaaaacgaactcacccaaaacacattgatccttatgatatcttctgtgccatgctctatgtccttaaaaatggctgtacttggcgtgatttgccggctgattatccaaagtggtccaccgtttactactattggatgagttggtcaaaagcccccacccctgataaaccagttttattaactcaggttttaaaaaaattgtcgctgatcgacgattaaggcaagggcggtcagcccgaacttcgttcgtcattttagatgcccaaagcattaagaacaccgctaccgctgaaaataagggttacgatggtggcaagaaaatttccggcattaagcgccatttagccgttgacatcaatggattcccgcaagctatccatattacccgggctaacatcactgatcgtgacggggcgattgcactcgtcacccttaatttagagcagtttaaattggttcgaaccatgatggttgatagtggttataccggccaaaattttgccaatgagattagcagtttaacctcagccaaggtaatcgtcgttaaagaaatgagttacaccaattttcggttatcccccaacggtggctcattgaacgttcatttagttggttgggaaattatcatcgtttatggcgtaactgtgagcgtaagctcaacactagtcccatgatggtttcgttagcttttatcaggttacttctcaaaagatactaaacagtttctcacaccagttttgatcattgccatttactatcatggcaatgaggctaagattgaaggattactgacggcatcacaagtgttcctgagtattgctttaccgtttgccatcatcccactggtcatgttcaccagtaacaagaagttgatgggtgagttcgccaatcatacttgggtcaagtacgctgcttggtttgccaccattgtgctggtaaccttgaacatctacttgattctccagacggttggcttgctgaaataaccgtttaaagacctttataaaaaataagtaggtttccgttatattctttataaaagtgtttagcagttgggagtcgttgacaatttaaaaatttgtctgcggcttcttttcttttagtctaaaatagaggttaataactaacagggggattactaaatgatcaaacccgaaaagacaatcaatggaaccaaatggattgaaacgattcaaatcaatgccgaagaacgggcaaccctcgaagatcagtatggcatcgatgaagatattattgagtacgtcactgataatgatgaaagtactaattatgtttatgatatcaatgaggacgaccaattattcatctttctggcgccgtatgccctcgacaaagatgcgctgagatacattacccagccatttggcatgttgctccataaggacgttttattcacgtttaatcaaagccacatacctgaagtcaacacggcactttactcggcattggataatcccgaggttaagagcgtcgatgcatttattctggaaacactgtttacagttgttgacagctttatcccaatttctcgcggcattaccaagaaacgcaactatttggataaaatgttgaaccggaagacgaagaacagtgacttggtttcactttcatatcttcaacagacgttgacctttttgtccagcgcggtccaaaccaatctcagtgaactcgatcgtttgccaaagacccattttggtgtcggtgctgaccaagataaaattgatttattcgaagacgtgcaaattgaaggagaacaggtccaacggatgtttgagattgaaacccaagtcgttgaccgaatcgatcataccttcaacagcattgctaataacaacctgaacgatacaatgaaatttttgacaatttggtcactgaccatggctgtgccaacgatcattaccggattctatgggatgaacgtgaaactcccgttagccgggatgcaatatgcttggatgctgactttggggatttctgtcgccttgattgtggcgatgctgattatgctgaaggtctggcggaagatgtgatgggtgagtgacttgctgctgggtgggggacttttttggaatgtgtatagttgagcagttatgctattttaagcacccttcggcttctgaaatacgctccgacgaccctgaccccggccacataagacaaaaaatccagtaacgaacaaaaaccgttcgctactggattttctgccttatgctctggggtcaacccgggtcttgtcgcgctcttattttttaccatttctttacccaatcaataccaagcaaaaacattacccttctatactaaaagtgttagaagctgtctaaaatctcttaagtaatagtgctaaaaacgctaaaacgaccatttgcagactggtggttaattgacgctcacaatttttccgaagtcgccgacaattctctagccaactaaaagatcgttcgactacccaatgttggggcatgacttcgaatcgatgcaactcattgcgcttcgcaacctgcacggttgcgtttaaattactggctacatcgagctgaaaattaacgcctgaataaccaccatcaactaagacattttgaacctggcgtaaatgcatggcattgtaaagcgatcattgcactggccccgtctcgatcagagacgttcgctcgcgtcatgtgaatggcctgcggaaagccattgatatcaactgccagatggcgcttaatccccgagattttcttaccagcgtcgtaacctttgttttcagcagtagcggtgtttttgacgctctgagcgtcaacgataataaaggaagttaaagcttaacgtccttggtaagttcgccgagcaatgacaatttttttaaaacttgttccaataaagaatcagccgtaggctcagctttagttgaccaaattttgtaatagttgtaaactgaccgccattctgggaaatcaccggggacttgacgccattggcaaccggctttcaagacatataggaccgcacagaaaacctcgtagaggtcatattttcgaggcttagttcgcttacgaaaattttctaaagctggtcgaattaattcaaattgttgccgagtaatattgctgggataatttttcatagcttaaactcgcttttcacatagaagtatatcaaaaatcatagatcttggacagcttctaaacacaatccagaaattaagccaaaaaacaatcctgaaaataaaaacgatcggcctagttattaggttgatcgtttttttatttatccggtttatgggcgttaacatagtcagcaaatatttttaaaagttcttcggtttgttcgaccgagaggttattagcttgaaagtacttttctaataaagcccctttttgaattaatcggcgagaacgggctttgcgggcttgccgattttcatagtatttagattgccgtaatttaaaatcttcccgctcaattttttgttttaaacgcgcttgctgctcgactagtttttcatattgattagacatggaatttccccatctcgtatggctaatgatctacggactttacctttaaaaattcagaaaattgcttggctaaaagcttaatctgatcgttagacaaattagcataatctaaattggcttgactgatgatttgtttacctagccgttgttcaatcttatttttttcgtccttaattttttgattaagggcttttaatttagcttcttgtttttctaagttactttgagacataacgatccctccaatcatattagaaataatcaccaaaactatatcatataagaaacgttaagtcaaagtataaaagttgaaatagcgaagcggaaggcatacactaagttaaagttaagagaatcagcagaccgagtaaaatgaggtcaatgcgcacttacaccccactaaattcttgtggggcaaatcgtgctaaaatcctgtattagaagtcgccgatggcgacaacaaagtcaaaacccatagaatcaaaggaagatggtgactgacatggcaatatttcacatgagttttagtaatattagtgctggtaaaggacgaagtgcgattgccagtgccgcttatcgaagtggtgaaaagctatttgatgataaggaaggtcgccactatttttatgcccgatcgatcatgccagaaagctttattttgacgccaaaaaattcacctgaatgggcgagtgatcgagagcagttgtggaatgaagttgaaaagaaagatcgtaaatcaaactcacggtatgcaaaagagtttaacgtggctttaccggtagaattaagtgaatctgaacagaaagaattattgacaaaatatgtgcaagaaaattttgttgatcaaggcatggtagctgatgtagcgattcatcgcgaccaccaagataatccgcacgcacatgtgatgttaactaaccgaccatttaacccagacggaacatggggaatcaagagtaaaaagcaatatattttagatgagaatggcaataaaatgtataccggaactagcaagtaccctaagagtagaaagatactgatggtcgattgggataagaaagaaaaaataattgaatggcgtcataattgggcagttagtgtcaatcaggttttagagcaaaaaaatattccggatcgaatcagtgaaaaatcatttgtggaacagggaatagctgacacaccaatgcaacacgagggaatcaatagcaaacggcatgaaagaaaggcatttaatcaacaagttaagaactatcgtaagtccaaagctggctataaaaatatgcaggagaaagtagttaatcgaggccacttggatagcctaagtaaacacttctcatttaacgagaaaaaagtggtcaaagagttaagccacgaactgaaaacttatattagtttggaaagtttagatgataagcggcgcatgctatttaattggaaaaacagtaccttaattaagcacgctgttggtgaagatgtcactaagcaattattgacaattaaccaacaagaaagttcactaaaaaaagcagatgagctcttaaataaagtagttgatcgcacgactaaaaaactttatccagagcttgattttgaacagacaaccgcggctgaacgacgggaattgattaaagaaactaatagtgaacaaacgattttcaaaggcagtgaattaaacgaacgtttaatgaatattcgtgatgatttattgacccgacaattattgacctttaccaaacggctatacgttggctggaagttattaatgcaacaagaaaaggaagtcaaaatcaagcttaaatatacgctgatgattcatgatgatagcttagaaagtctagaacacgttgatcaaggtctactagaaaagtattcaccaaccgagcagcaaaagattactcgcgcagtcaaagacctacggacaatcatggcagttaagcaagtcattcaaacgcaataccatgaagtattgaaaagagcctttcccaatggtgatttagatgaactaccaatgattaaactggaacaggcctatacagcagtgatgtactatgatccagctttaaaaccgtgcaaggttgaaacaatcgcacagtggcaggaaaaaccaccgagggttttcaatacccaggaacatcaacaaggactagcttatttatcgggacagcttagcttagatcagttagagaatcatcacttacaacgggttttaaagcatgacggcactaaacaactctttttgggtgaatgcaaagccgatccgatggttaaaaacagtcagattgagaaaatccaaaagcagttaaaagagcaacaagctaaggacgatcaatatcgaaaatcccagctggcacattatcaaccattgaactacaagccagttagtccagaatattacctaaagacggcctttagtgacgcaatcatggccgctctatatgcccgtgatgaagattaccaacggcaaagacaggcgcaaggtttaaaagaggccgagtgggaaatgacgaaaaagcaacggcaacaccaaactcgaaatcggcatgaagatgggggcatgcacttgtaatcggaataaaaaatgcaccgttaaacctggttaaaagcggctgaacaaggcaaaacagaattagaacaaaagctgaatcataaggagtgaacgaacatgaccactgttatcttagctgaaaaacccagtcaagcccgttcatacgtccaagcctttcaaaagagcacaaaaaaacagggttactatacggttagtgaccctgttttgcccgcaaatacgcttgtgacgtatggtctcggacatttagttgaactagccacaccggataaatatgatcagaaatatcagcaatgggccttatctaatttaccgatttttcccgataaatataagtttgtggtgtcagctagtaaaaaagatcaattcaaggtcgtcaaagacctgttaacgaaggccgataccattattgttgccaccgacagtggtcgggaaggctctaatattgcgtggtcaatcatgagccaagcccagattgacgttaaaaagaagaccattaagcggctatggttgaatagtttggaaaaagacgccattattaccggattcaaaaatcttggtgattggcaccaagactatttggcgtataaagaagcccaaacccgtcaaattagcgattggttaattggaatgaatggcagccctttatacaccttgctattaagacaaaacggggtgcgcggggtgtactcgattggtcgagtacagacgccaactttgtatatggtttatcaaagagaccaggcaatcaaaaactttaagccagaaccttattttgaactaaatgcggaaattttaactaatcagcaaaaattcgtcgcaaaattagacccctatcagcgatttaaagacgaaacagggctaatgacattcatgcaggctaaacacgttcagaaaggctcacaggacggttttatcaaggacgtccaaaaacaaggcaaaaagcgtgctagtccccaactattctcactatccagtctccagagtgccatgaataaacgttatcatgccagtgccagccagactttggcggccattcagagtttatacgaagacaaactgctcagttatccccgcaccgattgtgcttatatcactgatgaagaatttgattatttagtggctaatctgacgaagtatctggggttggtctctaagcaagtcgctttaaccaataccgccccgaataagcgctatgttaatggaaagaaggttgaagaacactacgccattatcatgactaaaatcgtcccgacgaaagatcaattagctgccttacctaaattacagcaacaagtctatgacttggttttaagaacgacgttagcgatgtttgctgatccgtacgagtacgaggaaaccaccattattacccaagttggtgacgccaattttaaagcaaccggtaaggtcccaactaagcaaggttggcaagctttatttgatgatcacaaagccgaacagcaagaagcagcaaccttaccgctcgttcaccaaggcgaccaagttcaagcgaatctgcaaacaccgcaaaaaaaaacgacaccaccggtaccctttaccgaaggtaccttaattacggcaatgaagacggccggtaaaacacttgatgatgaagaagcccaagcgattcttaaagatgtgcaaggcattgggacaagtgcgacccgggccaatgtgctggaagtgttaaagaaacgcggctacttagttactgaaaagaataagttgaacgtcagtgaagccggaatcactttatgtaaagcagtcgaactcgaacccttgctaactagtccagaaatgacagctaaatgggagcaagcgttacaacaaatcagtaccgaagaacgtaccccagataactttttgagccaaattaagaagtttgtggcgaaattgatcgctgatgttccgacacaattaaccggcagtgcagccattaagcaacaaatcgatcaccaacagcaagtccaaaagtccgacgaggtcttcttagaaaccccgcaagcgaccgttttaaataaacagaagttttacattgtaaagcctaagcaaggcgaaagctttaccctacccaagaaatggagcagtaagacccttggtaagaccgcaattaaagcgctggtcaccaaggggaaaaccagcaaactaaagggtttcaagagcaaaaaaggaaagtcgtttgacgccaagttaaagcttgacggccataaattaagttttgattttgattagaacctgcctaccgcccttcacgttgttccggttggtgaacccgtcatttaggttcactttgacaaccctaaaagtaaacctaaacaacgggtgagattagcaacgcaaagaagatcataaatatggataacgaattaacagtcattgggagtgaattaccggttttgcaggctaaaggaacctacaagtatttaaaagaaaccactggtaacggagcctattatcaagtggcctggcaaaaattagctgatggctacgttgccctttatggcacgaccccgattcaaatcaacgtagcccctctatattgaatgatatttttgaagatgaggaggggtaggcaatgccgagtaaagccgacgttaaagcctggaaagcacaattagtcgcccaagccgaacaacaaatcctaaaattaaccgatagtgaccgatttaaacagtatcttaataccctggctaaatttcatcattatagcgccagaaacattgatttgatttatgcgcaaaatccgcaagccactcaagtcgcgggctttaagcaatggcaaacagattttaaccgcaccgttaataagggcgctaagtccattagaattgcggcaccgattattaagaaattaacacccgctgagcaaaagcgacttgatactacgtgattgagcttagtgacgggttaaccaaacaattaggcctacaagaagcacaaaaagaacctgagcatgatttaaaaaagctatcagcccaggatcttaataagtcctatcaaagcttgcaacaacaagttcagcaagcaacgaatccacaacaaaaatcagaactaaaaaataaattaaatgatgtacaccagaaaatcagtcatcgaacgcaaaaacagctgcaagcatttgctaaaaagaatccagaaattaaacaaccagattctgaacccgatcaaagtctaaaacgttagccagtttttaaagggcatgctataatggagacagaaaaaggaagccctgcgctaacaagacttcccatgcaagccgcttcaaaggcggtggcattagttaactaaacgatactgtcgtcccgtaactcgccaaagttataatcggggcggcttttttatttgttccttttgtcgatgtatgttagcaacgctaaaataaacattgcaaacagcaacatcaacgagagtgtctggaagacgctcattgactgtgaaaccttcctgaagattattccatgttcccatgggcctcacctcgcaagggaaaagacagccaccgcccttaaaacttcctgcgtaatctattatacaggtgaattaagtattgaccaagaacaataaaaattaagtcatggagtttcataggatcctaaatttgatcaaattaagctcagcaaaacatcttttgtagatacccttttttaagttcttggagtttttcaagcttacgctgatgaagagtgatgagatggtcaagttgtttgaaataactgcctatttttgcttgttcatcattatttggaaagtataaaattaagttttttaactcacttgcttttacaaggggttgtcctgtcccgaaagataacttcttcagatcaaattgcgtaagcaagttgtaaataaacgctagatttttcccttgtatgaatacagtattatccgtgatttttacctttccagaatgatgatacaagttcccagcatttgcaccaactcgagctgtcaatataaaatcaccctcatggttgtaatcttcatcataaccaattaccgatgtagaccctaaaacctcatattttgctaaatctgatttttcttgaagcatatacttacttttcccagtaccaatattatctacagcatcacttaacttacgctgttcccaagcgtcagcaagcactgaaaatcttaattgcgggaacttgctaccattttgggggaacattttttgcaaatagccctgtttaagttccttaagcttagctaacttacgctgatgaagagcgatagtgtcatctatctttttgaagaatgcccctattttttgttgctcatcgaattcaggaactcttaacttcatatccctaattagaccaagtgctataaatttttgagtcccacctgcattttctttttgaataaaccgattaaaagatggcgacttaagatattgcagtaaccatttattcgttataggattagaagttttttctttaattagtgccacatttttaatagcaaagtcatctctatcaacaattactggattaccgatagttccgatcattccgaataaaatatctccaatactaacctttgatctcttattaatttcattaaaatctttatccgttaagaatgatacatctgtcatgtctaaaccagaatgagttaaatttttagaggttaccatagggtgtccttggctaacgtactttggagaagcatgtgttccatctcttacatcagaaaattcacccaacctacgcttttcccaagggttagtgaaacctttaaatcttaattgcggatatttagcttggttatctttcattgtgggcctccggctttgactggtcattaacctgggtggccactaactggctagctaattcattaaaggcttgttcattttgactgattttctcgtctagttgctttagatcagctttaacttggtccagatcgatctcgggttccggttcaaacgtatcaacgtagcgcggaatatttaagttgtagtcattctccttgatttccgccggtgaggccacatgggcatatttatcgacatcttgccggttttgataagtggtcacaattttttgaatattggctgccgttagcttattttgattcttgtccttttcaaattcccgggacgcatcaataaacaagacgtcatcagtagttttgtgtttctttaaaatcatgatcaacgttggaataccagtggaatgaaaaatattggcaggtagcccaataatggcatcaatccgattatccagcaggagtttttgacgaatcttaccttctttagccccccgaaatagcacgccatggggtaagacgatgcccatagttccgtattcctgcaaatgataaaagccgtgtagcagaaaggcaaagtcggctttagatttaggtggtaagacgccatagtcgcggaaacggggatcagacaagcgtttatcactgttatcccagtgtgccgagtagggtgggttcataacgaccgcatcaaataagtaaggttcgtcaaccggccaatctttacttaacgtgtcgccattgcgtaagtgcatatcgtcatacgagacgccgtgcaacatcaagttcattcgggctaggttataggttgtggtattcaattcttgaccgtggtaactcactaaacccggattttgcacgtgctgtccgacatttaacagcagtgaaccagaaccaactgctggatcatagatagtccgcacttggttgtcacctgcattgcgctgataggtcacaatctgggcaataatgtcggacacctgtcgcggggtataaaattcccctgccttcttaccagaatcactggcaaattgcgcgattaagtattcataggcgtcacctaggacgtcgccttgatgatggacgagatcaatcgcatttaaagccaacatagtatcactaatagtttggttccgttgttgtaaagaactacctaatttattactacttaaatccacatcggcaaacaagcccgaaaagtcttgcgctgaagatagattttgtgtcgactgttccagatcatgaagtgcctgtgataaatcgtctaacgcaaaattatgggcttgaatcttgccaattagggtggcgtacaacgcctggggttgaattaaatagccgagcgtgttttgcaaatactcaactaaactgggctgcactgagacgccttccaactcaaactgaggatccatatactgagcatatttctgagtgacattttcggtttcacctgcccattcactaaaggtcgtcaaggttttctcggataggaatcgataaaaaattaaccctaataaatagtttttatattcggaggcgtccattttcccgcgtaagacatcggccgcattccatagggcgctttcaagttgactagcttgcgttgttttttctgacattgtttaacctcacttatttttgtaaatagattgctaaatcgtgttcaataaactgccgccaagcgttttgggacttaattcgatatagcggcaaaatagctggaatcttcggcccagtggcagtttgagcttgtaaggccgctgttaaacttgctgactgcgttaattcttgttcatgatgccattcatcagtccccacgttgtgttcgcgcgccacccgcaagagggctgcttgatctaagccccacgtgtgggcaaaggccgtcgttttttggaccaattgtctctgggcgtaatcagtcaccaactcccgagcattcaacgctactggcgctttattttggtcactctgttgctgcgactgttgcatttgttgctcaatatagggcatggcttcgcgaattaactgggcctgttgcggttgcgtttccgccaatttattcaaactagcctgtactttggcactgttttgcaggtaatccgtcatatgcgcttgggcttgatcaggtgtcgagtactgttgctgttcatcaatccagtcttgaattaattgcgtcaaataatcatagtccaccaagacaactgaaccaacagctaaggaaaagtctaaagcagctaattcttcggggactttctcgggctcttggttagtgaccgccgctttaatccgcagatatttacccgtataggattctacttcgggctgagcgataccaaaggccttttcgctgttctcccaagtaaaatcgttgtacatcgatagtgagttcaattgttgattcacttgacgaaaggccttcacaaactgcaccttggcagtggttcctttcaggtcatcggccgccgtaggcgttggggcaatggcttttaaatccaccacagccttttgaaattttaagacggcctgctgataagtgggacgaatgatgacattaaacgagccttcgccactatataacttgtaagcttcacgttcattagcttccatgattgccggcacccgaaaggtcacaatttgaccctcttgttttaattcccggttttggagccggttggtgcgtgagtaggattgaatgagttcttgataagctaaggtgcggtcaacaaagagcgtgtttagccgaggagcatcaaaacccgttaataaccgccgcaccacaatcactaaattaatttcctgatccggtttcaaatgagcaaagaccgcctcacgccgggcagcccgttttgcgacatcttcgttatagagattcaaatcggctaaatcaaaattagtgtgatactgctgattataatcttttaaaatggtggccatttgatcatgtttgtgcgcactctgatcttcgttttcacttaatgaataagtaatcgcaattcggggccaattaggatccagctgattatgagtagtctttttcgcggctttaaaggcttgataatagcgttgcgccatttcaatggaactggtggtcaaaatcgcattatagttgccatgacccaaactcgttttacgtgggcctttttgtaaaatatattgaacaacttgttggatatgttcatcggtctcaaagtcagccggagttaaatacgtttcttccaagtcctttactgacatcgcttgaatcttggcttgaatttttgcttcatcagctgtactcagcaggcggccttgcttatcacgacgcgctttgacgcgctgggtttctttttcgagggcccgggttattaacgtgtctttgccaatcgttgttacatgttcgacgttaaacggtaacacggcttggtcctctaaggcgtctcgcaagttataaacatgacagactttaccaaatagctcctcagtcgtaactgctagatcccccttgagctgtttcttattttcattaaagataggggtgccggtgtaaccataccaattactgttgacaaacgctgcccgaatttccttttgcatcttaccaaactgcgaccggtgggcttcgtcaacaaagaagattacccgttgttttaaagtcttgctaaagcgggattgcttaccggttgccagctgggcttgcgtttttttgaccgcccgatggagtttttgaattgaggtgaccaagactttaccgtcattttgttgcaatttacgcattaaatcaccggtgttttgggcttcgttaatggcaatatcatcattggcagcataggcactaaagttactagttgtctgttcatctaaatcccgccggtcaactaaaaagatgaccttatcgacaccaggatcttgcgcagctaatttagcggttttatatgaggtgagtgttttaccagaacccgtggtatgccaaacaaagccatcttgatggtcatgaatccggtgcatcacggcttcaatcgcataaatctgataaggccgtaagagaattaagctctgacgttcttggtcgatgaccgtatattcactgaccattttgtgggccatgggaatattaaggacttggcgcgtgaacgctaagccgttttccacggggtgattatcccgtgtccgccaattaaacaaaaaggctttgttgaaacgatccggttcggcattcgcaaaatacgccgtactatctggcgtcataatcacaaacatttgcagcagcgagtaaatccccgtatatttaccttcttgcgcgtatttttcaacttgattaaaagcctggttaagttcgaccgtggctttttttagttccaattgaattaagggtaacccattaatcaatagggttacgtcaaaacggcgatcaggatcgacatcttgagtaccagctagccgtggtcgcactgcttgtcggaccacttcataactagatttaccgccagcaacgtccgctttccaaaacaactcgagcgtcaccgtgcccaacttagcatcatcacgttcaacttcaactttgccaatgccattctcggcggctagtaatttagccgcttcgtagggcgtccggacctcaatcgcccgtttaacttgattaaattcggtatcagttaaagggtgtccctgcaatttagcatagttattgttatttaatttatcgcgaaaattagcccataattgatccggcgtcgcaccatacaggtcttttcgttccacccattgattacttccggtcgttaaggttttaacaacttctttttcaaacgacagctccaacataaaaaagtcccttccccctgcttttaagttacttactagttagttatatgtgaaattgtttgaaactttttttgaaaacaaagtaatttgttatttctttctctcataagaagtttccccttaaaatgatttttcattttatatgcaaataaaatcccatccacaagccctcagtaaatgctcatctttgtcagagatctcagattcaggcaaagcaatacaaaccatacccttcgctcttgttaaggcaacgtaattaagcgacattctttcgtcattactattcttggactcttttccctctaaaaatggtaaaattttttgaacatcatgagttctaaggaaggtttctaacaacaaagttgctaaatgtgtttggcctttgacactatggatactgcctaatttaatttcaacctgtctatccttatgggaaaaaataaaactattatttcgtttcttgggggattcaatctgattatttaattcttttcccatattatcctgccattcaaagaaaggatttctggtctcaaagttttcaatagtttcaagtgttagttcgatattggaaactgcctctgtccatacttttttaggcaaatcttccttaaataataaaagcttaatattacgcctaagcaacatcaaatcttcgtctttaagagttttagagaacacactaaaaggattcttatacaacctgtacttcttttttcctgttagtaaatcattcaaaaaatcaactaggcccaagattatcattttaacagctgattcgctctcattactcttcttaactaacaaacgcgcacgtttaacatatttccaaaaatgatcatatttaactctcaacttatcaacattagcattagatggatcgtattgtggccaatatgcttcaatattagcaggaaaatgcttttgtacgtccgctggatccttaattttgtggacccggccgattgcaaaacattcatagccttcacagccattaatttcttcatcagaaaagttgtctagaaccaattgtccaaaggttggaagtacttttgcaatactattttcattaaacattattatagttgctgggatattcttaaaatctgtgttaacgcccttcatggattcaccagagatagctaagggattggcaatatttgcgattttatcagttaaacgttggctatccagaatactaaaatgcggagaacttggaataacggctttagaataacgaataccatcgtcataaatgctttggtttgaatcgccaaacgcttgaatatcagagttagagaatgaattccttactaaatcccaaagtatcaatgatgtatcttgggcttcgtcaataaataataacggaaaacgtttcgaaatattttttgatatttcagaatgcttttttatcgcaagattcgaaaaataaatgacttcatcataagtcagatttccctgtctaatcgaatattcaatgattttcttaattcttttttgagttgcactagattctgagaacgtaaatcccttttttaaggaatattccatgactacattacgatgagaatcaattgccttatttggcccaataatttttcttcgcattgccaaggtaatactagaatcgatagtttgaatgtgaatacccatggatctaaaccaaggtttaaccacaaagtcactaaaaaaagagtggaatgtcccaataaaattaggataactcaataatttttctccataagatgtaccgcccaatcttcgctgaacttcttcacgtgctgcatttgtaaaagaaagtacacaaattcccgaggacatattactcctcttttgagcaagaataccaagcttagtgattaacagagtcgttttcccagtgcctgggaaggcttgaatatcttgaaaatcatttggcggcatactcttaataatctctcgacgattaaaatcaaagtgtatttggttccccattgcaatttcaatttgatcaatatccgcatctgttattacaatttcactatttttcattatttccaccagttacgtatttaatggcatcaactaaataagatgggataatttccttatatgaaatctcagcacccaacatgtcttctaacttattagctaaataattagcaaattctgctttgtgatctttaacatgtttatagaataatacagaacgactttctgaatctttagcgtcatcgaaacccttgagccatttagtttgagtttcttgtttaattccagtagcttgaaataaagcatcaatcaatgtctttttaaatatgtcattcttccaccctgaccaaacaagatcatattcaagtgtccaatgattggaaataaacgcctttacatcaccgtcattaatatcctcttcccgttgctttaatttatcttgcagacttggatcttgtagaagatcactttctgtgtgccaatgacgctttgcattttggacatcctggtttagaatgtttggagctacgtctggttctatatctctatcagtaatgcaagccacaggaatccccatctttgtgtcatcagagcgtttaaaaatatttgcataatgtattaagcccttactcataacatttactatggaaacaccatagtcagaaagatttcgacctattaactttgctagtgttgggagaagtatttcttcaccacttccctcaacaatcagcacgccattcgcaaaaaacaggttagatttggttgcgtctaaaaatctttcgagaaacttataatcatttgcagcaagttttgtgctcttaacatccataggataaacttttccagattttacaataaccaaattttccaaatgtacaacggaggcaagcagtggtgaatgagacgttacaattatttgatgagaagaatcattagctgaagactccaaagaccgaatcaacttcatttgacgctgtgggtgaatatgtgcttctggctcttcaatgagagtgaactggcttgagttacttttttgcttctgcaataaaagttcacatgccatactcataatattactagttcccaatcccggaatcccgtagacatcctttttatcgtgatcaacgttcagcccaactttttctaggagggataaaactttctggctttcagaaacattggaattagctacctccaactttgttttaacttgatctccatttaagagcattgtctgagttaaaatactattcatttgttcgctggcttttaccaaaggcgcgaaattttccaaaaggtagttcgtcaaattaaaaattccagtgagagacagatctgtaacttgggtttctttagaatattctgagcttccgcaatctaagttgggtacttgtttaatgacttgtgatagtcttgagcccttcccagcctgcatatccatgtatgcgtccctcaaaggcttcaggtatgtagttctaaacatctcacgggcctccgcaacaaatgtagggccatctccattctttcctgaagttatctccacaataggtcgagctggaatgaattttagactaaagtggcaagtccaattcaagtagacaactggtccacttttggtataagtaagatattctaaaaataatgctttctcatcttcagttaaattattgaaacacacttgtatttgaatttcgttattaagatcgttattgaagacgtctgatggtagtatacgattccacctcatatcagtagttcccattgcataccgcaaggcatcgataatagcagattttccagcatcattttctcctaccaatactgttaatccatggtgaaactgaatagtacatacttctggaccaaattgtctaaaattcttaattttaagtgtttgtatttggaagcttttccctcctaaatttttcttaaggttaaagattttgttcattagccattgtttatattaaaacactcataataagtaaattatacccgggtttatattacttcccaattaatttggtcaatttattcatgatggaaaaagaatgtttaaagaatcacactaaatagcaacgttaatacagattactaaaaataatacatatgtatttactatgtgattgtagcatcctgaaaagcataccattcattttgactattagggtatgccttaatggctgtttttgatagcatactatacttggatttatagatgtttattaaaactgtctaaatgagaagaccagacattgttttattagtatgaaaagaggtgatgaacatagcggaacgtccaatttttgtagaaatatgagcagcaagacgttctctaatttttattggtatattttattggtatagtagattgtaaaattaatccgaacgctgttcggacaaaaaagatcagcttcctctaaaatggtgtttaccacaaacccatcttttaggagctgatcttttgtctagtataacctattttgaacgaattaaaatcgaaaccttttgtgaactagggctgtccaatatccaaatgggcgatcacgatgtggtcggaaaactaaactgagtgacgaattaaagcaaaccattctaaaccatttacgtctaagctggtcaccagaaatgattgctcacgaatttaaactagctactaaatctatttacaattggttaaatcaggggaaaattgatttccccttgaatgatctacctgaacatggcgtacgccaacggcgtaacgttgaccaacggtccaagtataaccaatcattaggtcagtcaattaaaaaacgaccaagcgtaattaatcaacgtaatcgcatcggtgattttgaaatggatacggttgttggccctcgaggacatagtaaggcagttttattaactttactcgatcgtaaatcacgttttctttgggcttaccagctaaaagatcggacagcagcaaccgtcaatgaagcgctgactgagtttttaacaacttttaagcggcctggtttcatttgaaccacggtaaggtatccagggtctattactgtcatgcttatgccaccggctgaacgcgctagtaatgaacgctttaatcggaacttacattatttttaccctaaagggacttgttttgagcacattagtgctcaagatttgacaactctgttactccaaattaaccaaagaccgcttaaagtactcaactggcaaacaccttgccaagtcatgctgactaatttgtcaaaaaatttggattaaagttgcaatctaccgaattaattatggctcgtcaattcgacagcaagaccagccgtcggattgccagtgaccttcatcgcaactctagtacgatcagtcatgagttgaaatgtggaacgggttgtcaaattggtgctaatcatcagccttttaagacctactttgcggataatgctcaattgatttatgacaaccatcggatggcctgtcgcgctgtaagttaggtgttaagggtacctgaattcttccgccaattagtgtttggattgcattgtaagccgcgtattcacagtgttgattcctttgtacactggttcaaaatgaaccaaccggaactaccatgtccgtcgacggccgcttagaactgactaacagtgaactgacaatgaagttgcgccgacgggtaaagtcatctcgcaagactcacagcagcatgaataatcgtcctttagtgaagctgaaaataccaatagtgggctcattttagccacctcgaatgaacttttcaacacaatttttagctcaatcagacctttaactaatttacctgattgttgcaattactatatgtagtgctataatgtcattctaaccaccatatatagaaaaaggacgatgattagttacggaaaccataaatatcctctacatcagcttgagtggcaacacaaaatattttattagcagactgacaacatactttgagaaagaacgtcatgttcgggttagttccattaatgttaaagaacaccctgaattcaccactcttgacaagccgtttgttaccttcctaccagcctttcttaaaggtggtaatggggttaataacggttatactgaaatattaactactattttgggagattacctcgcgtacgaaggcaattaccagcattgctacggtattatcggtagcggtaatcgtaattttaataagcagtttgcactcacggctaaacaatatgctaaacgcttcgattttccttacattaccgattttgagctacgtggcaccgcacacgacattcctcgcattgccgatgccatcttaacctatcgcaatcaattttgttttcaaacaacaaaggagtaatccctaatggtaactagcaccccagaaatggaaaatacctatttttacttaaataacctcgtaaacatccctgtcgacggagaaattccgctatattacgatcaagaagccctcaaggcctattttgaagagacggtcgaaccaaagactaaacaatttgattcattggatgccaaattaaactacttagtcgacgaagattacattgatccagatatcttgaatcagtattcccacgaatttgtgcggtccttgttcgaccgaatgaaagaccatcacttccatttccgcagctttctcggcgcgtacaagttttacacacagtacgccatgaaaaccaacgacggacaacaattcttggaaggctttatcgaccgtgttgtcttcaatgcactctaccttgcaaacggtgatgagcaacttgctaatgacgttgccgatgaattaatttcacagcgttaccagcccgccactcccactttcctcaacgcggggaaaaagcgccgcggagaaatggtgtcgtgtttcctaattgatatggccgattccatgctctcaattggacgtggcgttaattctgcccttcaactatctcgaatcggtgggggcgtcggcgttaacttgtcaaacttgcgcgcctcaggtgatcctattaagcagatttccaacgcctcgtctggcgttgtaccagtgatgaagttacttgaagactcatttagctacagtaaccaacttgggcaacggaacggcgccggagtggtttatctcaacgtcttccatcctgacatcttacattttctggataccaaaaaggaaaatgcggacgaaaaaattcgggtgaagaccttgtccctcggtttgattgttcctgataaatattatgaattactcaagactaacgaaccaatgtatctttttagcccctatgatgtcgaacgtgaatatcgtacgccatttgcttacatcgatatcaccaaagaatataacaacatggtcgctaaccccaatattaagaagtcagtctttaacgcacggaaactagaacaaaagatttctcaactccaacaagaatctggttatccttacatcttgaacattgatacggccaaccaaactaaccctgtcgatggcaaaattattatgagtaacctttgtagtgagatcttacagcctcaagaaccgtcaaaacttgacgatgacctatcgtacaagacaactggcaccgatatttcatgtaatctcggatcaaccaatatcatgaatatgattgactcgccggacttcggtcactcagttgaggttgctgttcgtgcgctcaccctcgtaactgacacaaccgacgttaaggaagtaccgactgttaaacatggtaacgaactttaccacacgattggattaggggctatgggtctgcatactgcccttgcacgccaccaaattgagtatggctcaccagaggcccttgaatttactgatgcctacttcctagccttaaactactattcactcgctacgagcaatcgaattgcccgtgaacgccacgaaaccttcgctaaatttgaccaatcaaagtacgctgatggtagttacttcgatcaatacttgaacgcagactttgaatttaagagcactaaagttgcagagattttcaaaaacattaaattaccatctgttgccgactgggaggccctcaaacaggccgtcatggcggatggtctttaccatcgtaaccgacttgccgtggcaccgaatggttccatttcgtacgtcaatgaaacgagtgcgtcacttcacccaatcacacaattagtagaacaacggcaggaaaataaagtgggatcaatcttctacccggcaccctacctgtctaacgaaactttgccctactacacgcccgcatatgatatcgaccaacgcaaaatcatcgatacctatgccgtagcgcaaaaacacattgatcaaggcatgagtctgacactgttcatgcgttcagttttgaaacccgacctttacgagtggaaggacaatgacaacttgaagatgacgacccgggaccttaaccggttacggaattacgcctggaccaagggcatcaagtcactttactacattcgaacattcacagaagacgatgaaattaaaacggcaaatgaatgtgaatcatgcatgatctaggaaattcacttggggtcttaccgtccgtttaacacaccggcatacgttattgggtcacaagacccatatacccatgaatcctaattaaggagacgaacaaataacgatggactatttatactacaaagcaattaactgggatgatattaaagataatttcgataaatacacgtgggaacaactcaccactaacttttggttggacattcggattcccgtcacgaatgatcaaccagcttggcaacagctagcagacactcaacaacaggccattactcgtatgttggcaggtacatcaatgttagccgtctaccaatcagaagttggcacccctgctattcgccacgatcggagaactcaacaagaagaatccgtattaaacaccattacctttatgaaatcagtccatgccaaaagctgtacgaccattttccgggctctgattccgggtaacggcggtgaaagttttacttgggcagatgataatgccaatttgcaagctgaaatcgaccaactcgctcaaacgagcaccaatggcacggctttacaaaaaaaagccctttttattttgaccgaaactggcctttcatttggtaaatattggccaacccttcaaacccattctctcgtcaatacctaccaaatgttggccaatattcttcgtggaagtgccatctttagtgcctatgtcggctacaaatttcaccttgggtttgaagacctcgcgtcaagtgaccaagccgaactgcagcattggattaacacccagtttgatcaactcatgcaaactgaaaaagatttcttagaagctaaccttgacgatgccaccgaagccatcaatctggcctcctatggtgccaatcatgcattaatgtcacttggctttaacgctgtctacgaagttcaaccgtcttcactagtggcgcaactcaaagaactgatgattgaccaaaatcaattcttgcaacaggtaacggctgcaaacaatgaatcggacactgaaaaaatgaccgatgacgactacgacttttaaggagtattcaactaatgagctataaaacaattaattgggacatcatcgaagacgaacttgacgaatatgtatgggataaagcaacggcacaatactggctggatacgcgagtacctgtttctaatgatttacgggactggcggacactctctggcaccgaaaaatcggttatcaatcgggttgtgggtggattagccttgctggacacactccaatccgaagaaggagtcgacgtgatgcggcccgacgttcggacacgaaaagaagcagcagtcctcaatgactttttgatgatggagtcaattcatgccaaaagttacggcactattttgacatctttgaacgatcaagccactgttgacgaagtgtttaagtggatgaacaataatccccgaatgcaatacaaagccaaacggatcaatgatatttatcaaacggggaacaaccttgaaaagaaagtcgcaagcgtctttcttgaaggaattttgtactacaccaacttttttaccccactttggtaccgtggtaacaataagctggcaaatctttctgaagtcatcaaactagtgatccgtgatgaatctgttcatggtacctacctcggctacaaattccaattgggatataacgagctatcagtgactgaacaaaaaccattcaaaaagtggatggatgagttgctcgatgatctccttgagaacgagtttgcgttcaccgaagaagtctacgcgccgattggtttagcggaagacgttaaacaattcgttcactacaacgccaacaaggcgctccaaaatatgggcttcgaatctcgcttccccaatgctgagattaaagatatcaacccaatcgtaatgaacggaatttcaaccgaaacggccaatcatgatttcttttcacaagttggtgctggctatctaatgggtaatgctgaagctatgagtagcggcgactatgacttctaacataggcttctaggcataattcaaatttaaaaaagccaatgtccacaggagatattaaaggtgcctctgtcaaccggtgttgacgaagttatatttagaaaccaatttatttacgaattggtttcttttttcgattttgattccaatcccgaattcgataaataaaggttttccagttcttgtaatcatacgcggttcttttgatttgcttgattttacggttcacaccttctgcgaaatcatttgatacccgtccgtagtcatattttttatgagttgtacccgagtttgattcaaagcttgtacggccatttgaacaagatgaaggttatccacgatcagtttggcgtgtggaaagagtgttcgaagagcaggttgatattgagaattaaagtccatgacaacccgagttacgcgctcacgatgacgtttagaataacaattgagaaagaaatttttaatatcaggtagattgtaacactcttggtgctgatcggtaccatccggattttaaagctgactattcgtcataatccattcggatgataaccggatccttagttagaaagtcacctattccagataagaacttttgaaagtggggagtgttgttgtggaattcaacagcgtcagcatctttccaatgttcaatgatctcatactcggtttttgaattgacatccttgtagtgatgataactaatgtttccggcttcgttacttgagccagcaactaaatcggcaataaaagcctcgtaagcagcctgtttacctggaattactgacagttcaacgttgatgactttcataattaaaactcctttaaaatatatttactgtaattataatatcgcaataaaggtctaaatatgtagaaagtgactttgtttttaaaaataaaatttgaaaagctttcattttcttatttacttttaatattaaccgtgatagtattctatacaattcatgaaaagaggaatgaaaatgaccaattcaacatttaaattgaacaccattattacccgcgtaattattattatttaatgtgcgggcgaattgatgtgcccgcaagcaagcgggcagaattggttatttaacaccaaggactgtcttaaggtccttggtgtttttttatttttaaggaggtgacaaacttcccttaattatgaatgagactgcaattattggtagaatttacttgttttgattgaataggagtggagcaaatggaagaaatatcaaatacatattctttaacagaagcaaaagttgccaaaatggaacgagatccagttaaaactgtcgttatggcatctatgattggaaccgcaattgaattttttgacttttatgcatacggtactgccgcagcaacatattttccaaacgtctttttcccatcagtaaccccaacaatcgcaatgatccttagtttactgacattcggagttgcgtttgtagctcgccctctagggtcgctattatttggtcactttggcgataagttaggtcgtaagcgggcattagttgtctcattgctgatgatggggctatctaccgttgtcattggttttcttcccggttacagaactttgggaatgactgcaattttacttctatgtttagcaagatttactcagggcattggtcttggtggtgaatggtcaggggccgttttagttgccactgagaacgctccaaagggtaagcgggcactatttggttcgtttactgaactgggtgctccaattggattctttttgagtaacggtttatacgttattttggaaaccgtattgaccaagtcacagatggtagaatttggttggcgggtaccattcgttgcctcagctgttctggttgtcttcggactttgggtgagaagaaagatgcaagaaactccattattccgattggctcaaaaacgggataacgtcaaaaaagcaccattggcacaggtattcactaagagctggaaacaaatcctccaaggaacatttattatggctgtttcctacacgttcttctttctactttcaacttggtcattgagttatggaactgccgtgcttggatttgatagccgtgaattcttgatgttattgatgggatcaatcgttgtatttgccggaatgattgtttattcgtcaattttgtcagaccgatttggccgcagaacagtattgcttgcaggaactgcagccatcttcgtattctcgtttgtatttccattctttttccaaggacaccaaaacgttgttggaactttattcttcttgttggttggtttcttagcaatgggagttatctatggtccagttggtgcaatgctgcctgaactcttcccaacaagtacaaggtattcaggtgctggaattgcttacaatatgtccgctatcattggtgctgcttttgccccaactattgcatcttggttagttggacaatgggggatccacgcagttggttactaccttgcatttatgagtttggtctcaatcgttgctttacttttgacaaaggaaaccaaatcagtggattacactaagtaaatataattgaagaaacgcaatcaagcaatttcggccttaaaggaggtggtggaaatgtcagatagcgacatttcaggcattatcaatattgtgaaaagtaaaattagaaaatggacgtgtcagttgtagttaccaagttagaataagattttcatggtaacggcaactggccataatggagggaaaaattatgactaatcaaaacgttaccttaaatacacaacaaaaatcatttgtccaagcactgtttaatgcttatcaaactaagcagccactaaaaagagcagactgggaaggggttgtaaccgatgatgaaacggcctatgcggttcaagattgcgttgcccagttaaagcagttaccaaccggcggctacaaagtttcgctgactagccagcaaactcaggatatgtttgatgctgatagcccactgtatggacaacaagttgattcacactttttaccatcaccagcggtcttatcattaaagcggcaaacaatggctccgttattagaagttgaattaggctttcgcgcaacggaagacttattaccaagcgatagtttagatgatcttcgtcataagaccaccgtttgtggaaccttggagctccctgactgtcggtttgctgactggttccccgacctaaataaatactgtgttatgagtgattgtgcagttggcggttacgtcgtgtatggcagtgagcggccagcagatgaagtattctcaactgttgatgatgctgccaacgtaagtgcgactctctatcatgatggacaaaaagaagcgacagggcagtctagtgaagtccttggtaatccctttaagtctttgcaatggctagtcggtaaacttgctgcccagggtaaacggttccgagcgggacagctagtttcatctggtacctttctcttacctccacacttaacagcaggcaagtgggaagctaagtttgaccacgggttcggtgatgtggttgttaatgtcaatgattaattagcgggttcaatcagaaaggaagtcttattatgactaggaaagtagcagttattggaatgggacatgtcggggcaaccgttgctcattacctcgttgcttgtggatttacggatgatttagcactgtatgacacgaacgaagcaaaggttcgcgctgatgcgcttgatttaagagatgcaatggcaaacctgccttatcatactaatttgaccgttaacgatgattcacaattggctgattgtgatgtggtggtttcgacccttggtaaatcgaagctagttgatacgcctgatcatgatcgttttgcagaatttaaatttacccgtacccaagtcccgttagtagcaaaaaaactggttgataatggctttcatggtaagctagtcgacgtaactaatccatgtgatgttattacctccatgtatcaaaaactgacggggctccctaaagaacacgtgctggggacgggaaccctgctagattcagctcggatgcgggcttgcgttggcgaagccttaaatgtagattcccgatcggtagttggctttaatcttggtgaacatggtaactctcagtttaccgcctggtcgacagttcgcgttttgggcaagcaggtggttgatctggctaaagaacggcatgtgaatttagctgatgtcgaagaacgttcgcgaaaaggcggttatatggtttataagggcaaaaaatataccaattatggggtagcaacagcggcggttcgtctgactaacgccttattgagtgatgcccgaacagaaatgccagtgtctaattaccgcgaagaatatggcacttacctttcgtacccggcagtagttggccgcgatggagtagttgaacaattgcagctcgacttaacagccactgaacaggaaaagttagcaacttcagctaagtacattaaagaccgggttaaggctgaagaacaacgagcagcctcaaatgacaactaatgctattaaatggtagattgtaaaattaatccgacgctgttcggacaaaaaagatcagcttcccttaaaatggtgtttaccacaaacacatcttttaggagctgatcttttgtctagtataacctattctgaacgaattaaaatcgaaaccttttgtgaactaggcctgtccaatatccaaatgagcgatcgcctaaaacgatcacctgccacaatttcttatgaattagctcgatgtgaaccttaccaggccgaagtggcccaaacagatgccgaatacaagcggtcacgatgtggccaaaagactaaattgaatgacaaattaaggcaaataattttaaaccatttacggctaagttggtcaccaggaatgattgctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaaggcagttttattaaccttaatcgatcgcaaatcacggttcctttgggcctaccgattaaaaaaccggacagcagtaactgttaatgaagccctaaataagtttctagcaacttttaatggcccggtgcatagttttacggtggaccgtggcactgagtttagtgggctagtatcacttgaagcacaatacggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgacaaatttgtccaaaaattcggattaaatttgcaatctaccatgtaaataaagatcagtctgttaaaatctttgggttttggcagaccggtcttttgttgaagtgaagaaaatttaaacattaagattatttttggctcgtgacaataatcattttgtatacccaagtaattaatcgagcgttgcaagtatcaaagtgtctccccgttaaagggcttagatatattagatgcaacttttttgacgtcttgaatatataatgagagcgtaaaatatcttgtgtaaatgcataaaagatttctgaattgtatagaaatagggaatgccttcccttatgatatttagtaaccacagaaaac

SEQ ID NO: 19 - DNA, 33819 bp, synthetic construct
  source 1..33819: mol_type = other DNA; note = Lactobacillus plantarum PDG8 - contig 19
actaaatggcatgaccccgaaagaatttcggaatcatgccattctaaaaactgcatagctattttaattatttgaactgtctacttgactcggagcagtttttttaatacgcattaaaagctgattgtctcaaagctaatccgaatagtggctaagtgcatttgtaatcaatactgcgcctaataaggccatggccgctgcaatcgtcactgcgtaaaagccaattttagttaaaagcaggccaccagcggcagatcctaacgttaagccatagtataaaaaagcactattaaatgacatgatggttgaacgattagatggcacaatattaacgattgttgcagttaatgcagtgacaccccagccttgagataaggcgagcacaatcagaataatcagcaatactgctaaatgttgtccccagatgcctaaggataagactaatgtagctgaaactaagccattaattgtaacgctctgttttttaccaagcaatgatataagtttaccggcaaagaaactcgcaacaaaattagcacttccataagtgataaagatgagaccagtttgtattgtgttgaaatgaaaggtcgcagttgcaaaaacacctaagaaggtataaacgctatagaacccagtcatccaagttaatgtaatcagtagggcagcgatggcgtgaggagtgtggactaatgtcttaaaacttgtaaaataaccgtcaggctgggcattctgactcggtaatgaaggtatggcaatggtcaaaatcgatgatgcaatcaaggttagcatggctgaaccccagaaggccatatgccaactactgagttgtgctagtaaagcaccgagtggtacaccggtagcaattgataatgaaagtgacgacataacgatgcccatgacttggttaagtcgttgaccattgaagtaagtaccgataaaagcccaaatgtttgggacaaataaagctgcaccgatgccagcgatggcacggtaaagatagaatgttagcaatgagtttgctaatccacagagtagtgttcctagtaagaagatgccacagccactgattagcaaaaaacgtttattaaagcggtcacctaatgggccgaataaaggtgcaccgatggcataacatagtgcgtaaacggtgactccgtatgccgcggtgttagtcggcacatgcagactagtagcgatagcggggagtagtgctgaaataataaatgcgtcagcaccagtcacaaaagccccacagaaaaggccaataataagccaattttcagtatgttggttatggatagtgatttgattgaaaataggactcactccttttgaattaggtacaactaggagtttaagggccttacaatagagaaacaagtgaataaaagtataccagcgactgtcgttaatcggatagaaatataccaccctagtttcgtttgtttttgaaaacagtggctattaatgataactaggtaatgtttgattagcaattgttgattatcaaaataactttatactgtaaaattggaacaatggtacttcctgatttgcgacttcttcaacgactaaaattcataatagtcctgattaaataaggctttccaatgttcaatcaggacataagggtgtaaacaccatctagcattatggcatcattggtttataatgatatttatattagcttattggagtgagtttatgaataagaaattattgtataccagtattaccactgcggcattattcgtggggacccaattgggtgttaacaatgcgcaggccgacacggcaactgataacagcgatacgacgaatcagacgagtgccacgcaggggagcactcagacggcaactaacgaaaagttagcaacggtcaaaccgactagtcagcaacagtatcaagccaacgtgcagactgccaaggggaacgtagtcacggctcaaaaccaagtcaatacaacacaagctaaagtggcgactgcgcaggggcaagtgactaatcaaagtcaattagttgcgattggacagtcccagtatgatgcgggtaaagcccgagttgaccgtgcacaacaaaaactggatgctaacaatcaggtcctcgctgaggctgagaataaagtcgacgctgctaagtcgcaaacggcagcagctgaaacgcaaattccagctgatcaacagcaaattgcggccaacaaagtcgctatcgccaaccagccagctaccgagaagaaagcacaaacggctaaggacgcggctgacacggccttgacgcaagctaaaactgaacaggccacggcccaatctgatgccgatgcagccagtgccgtcactgccgctaaacaggcgacggttgaccaagcatctgccgcccagcaaaaagcggccacccaagcaaatcaagctaaagtggccgtagcatcagcgcaagatgcggttaataaaaatacccaggcaatcaattctgccaagacagcgattcaaaatacgaccagtcaaattaatgcgaataatcaagctgtttccacagcgcaagccaaagtgaccgcagctcaagcagctttagcggcagcagaacggccaacgaccacgacggaatcgcaaaataagtatgacgctgccgaattcccacaatctcaattgactggggccgaaacagtcagcgtcgcctatccaagtaatggcaagtatgtgcctaatgcggataaaatcaatcagtatatgtttgaatatatcaatcagctacgggcgctgaatggtcaaccagcattgaaacagacggcgacgttgcaaaataatgcgattgcgcgagcagctgcccaagacgacggtggcttggatcatactagctcaagttatgcagaaaatttaacacaagtttatccgcaatggttcatgagcgatcaagaaacggcctataatgctgtgatgggttggtatgatgaatccaataacattgagtccggttcctttggtcaccgcgtcaacctaatatactcgactggtgatgccggagtagccatcaacttggccaaacacgtggcggcatttgaagtcgataatgccgggatgacggaagcacagcaagacaagtatgttgatttgttcgacaatgcccatgcgaatgccgctactgggactaaggccttaccagctgtcacgttcaattacgtccagacggcccccgctgatccgaagaagattgcggcggctaacgcaacgttgattgctgcaacggctagtttgaatggtttacaaaataccgggaagacattagcaaccacgctggctaaccaaaatgccagtttacaagctttacaaaaccagacaagtggcttacaagcgactgttacgactaaacaggcccaagttcaagtcgctgcaactagtttgacagcggctaatgttgctttgacgcaagctcaagggcaattagcaatggcgcaacagcaacaactatcgcccgttcgtaatttgaagacagcaatcgcgaagacggctgcggcgcaagtaactaccacgcaagccgctaaaaacttagccagtgccaagacattggtagccgatttgaccgctgaaaacgcccgattggcggccgaaatcgcggccctgcccgcgcggattgcaagcatgaaggcccaaattgctacggctgaacaacaaatcgctgttgccaaggccatgctcgcgcaggggcaggctcaagtcgatacagcaaacgatcggcttgctgccgggaaagcgcagctagatcgtaaaaaggccgatttagcacaacttaaacaagtgcttggcgctgccagagttgatttcgccgtcgcacaaggagatttaacggctgctaaagccttcttggcacgcgtcgaagctaacaaatttacaacgacgacggctgtggctgatggaattgttgaaaccacaagtgttgctcaatcggctggtgttactgcaccacatgcaaccgcgactgaaaccgtagcgaatagcaaagataccgctaatgccacgagtactagcgcagatgtttcagatggcaatgcaacaatgaagctggttgcgggcgccaaacaacagccagctgccgcaaaggccacggcgttaccacaaacggatgaaaaacagtcagcgagtttgactgtggtgggattactagcggcagggttctcattattgggtttaacaaagttacgcaaacgcgcttaatttctgagctcaaagctttttagaattattgatcatatgaaataataaaaacagttggattaggatagccgatggataccgggaatgatagataggcaatgaatgcttacctatggttgtcaatcagccgaaatccttggcctgactgtttttttagtggttagatattaagtttagtgaattaaacataaccggtattaacaataaaagacaactcatttttgatattttgtacacggcaaggctaatatttagtaatatattaagtaatacggccattgaagtttttttgattatttaaataaacgaattaaattaatggataattaacggaatgaaaaatgatccgttattaaatgcagagttgcaattgacagccatggtacataatgtgtccgtataatcccgtggatgattgggaaatccagggtggctaactgccgattgctttaaggggaattaaggttgtgaaaggaatagaggtatgggaaaaatcagtagcagaatggtctttgaaattatcacgattatcggtattgtcacttttgccgttatcagtctagcaccatcaacggcgaagcagcaaagtgtgcaattggatcacggacggatgagctacagcggagccgttttgaagcacaagtttgacggtcagggtacgttgcaggttaacaaacaggggcgctacgtgggtaattttaccaatggccggtttgaaggcccaggcgaattcattgcaccgaacgggtggcgtttgcaaggcaacttcagcaagggtgcgttgaatggtgtggtcaaactgcgggtcggcaacaagacttatgccaaaaaaattacgggggacggtaagttagaaaatgcggattaaatggtttagtttagtacggataacgggactcgtgctggtattgacgtatcactttttccaaacccagtttactggtggctttatcggggtggacatcttctttaccttctcagggtttttgattacgtcattaatggtggacgagtttgctcgttcggataactttaaactaatggctttctatggtcgccggttttatcgaattgtgccaccattatttattgcggtgttattggtgctaccgctaacttacttgattgaccacgattttgtgaccgacattggtaagcaggtcgcggcggctctcggatttacgactaattattttgaaattgcgacgggtggcagttatgaaaacaagtttattccgcacttatttgtccatacgtggtcattagcggttgaaatgcacttttatattttatggggcctgattgcgtggttggtcgctaaaatcagtcggcggttggcgagtggtcggcgcgcattgacccgttttcgctggggcttagggctgttgaccactgcctttgcgattgaaagctttgtcatgatgtactttggtgcggtcggcttaaaggacttttcaccagtctacttttcaagtctgacccactgttttccgttctttgtcggcgggcttatcggtgtcctgagcggcatcaaggctcaagggccaatctatcgttggaccacggcgcactgcaatccgatcattgcgggcgcggtgatgcttattagttttatcttgttagttgctttaggcgaccggatgaagttcgatgcgctacaaacgtatcaggatgggctgttactggctactgtactcgctggcatcatgatctatggcgcccggttgttgcatgaccacacgccgaacctcaaggaaccgcggtggatgacgttcttagcggatgtgagctatagcgtgtatctctatcactggccgttgtacgtgattttttcacacatgatggtcaactggttggcggcactgctcacgacggtactgtcgattatcttatccgcgctgtcatactacgtgttagaaccagtaattgcgggcaaacgcgcccacgttttcggtcatacagtgacgtggcgacagttgcagttacccgttatcaccgcaggagtattgttggcagttaataccggggtcgtagtcaaaaatgcaccgcaactttcgacactggaacagaatttatgggtgagcgggatttaccaagatattgataaaatcggaacgactcatgaagctgtgctcgcggccgtaacgcccaagaagaagcaggcaacgcctaaaggtgaccaagaaaaagcaccaggtgtttccattattggtgacagtgtcacgctggggacgcggagctacctgggcgatcacgtcgcgaacagcaatattgatgcggagggcgatcggacgatgaacctggcatataaagtcatgatgaaccagcagcgaagccatacgttacggcagtacgtggtgatttgtattgggaccaacgcgctggatgattacgaagaacaaaccatgaagatcattcatgacttggagccggggcacaagttgattctgatgacaccttataatgcccgggccgatgctgactggaattcatcaaagttggccgttttggaacggcgtctgccagctaagtataagttcattacggttgccgactggggcaagattgcggcgcaacatccagaagttttcaaagggacggatggcgtacacttcggtggcattcgggctggtgatattttatacgccaaggtaatcaatcaagcattgacggcagccaaacagactccggctaaaccagcctaatctagctaagtcagagcagttattagtagtcaatttaatagaaataatcagcttgcgatgtaacaattggcaggctgatttttttatgtttgtggttaaattgcgaagcggcgggattcgttgatggtaattgttcagattttaagtgacaattcgaccagtgtgcatattaattgtcccaaaattaaattatggttatcataagcatgtactcaaatataactgtaaggagtgattagaatgttaggatggctatggtcattaattgttggtggtgtcattggtgcgttagcaggtgcgattaccagccgtgacgttccaatggggatcattggcaatattattgccggtttagttggtgcctggattggtcaagcattgcttggaacttggggaccttcgttagctggtatggcattggtaccctcaatcttaggcgctattatcttagtattaatcgtttctgcaatcttcggcatgcgtaagaaacgttaggcggtgattagatgagccgcttagctaagtttacggtgacgttagtcggaattgtattggtgttattagcggtttttgaactgggtcagttgtacccgatcccgtggttgacgtcctggttagctgatctgacgattaactacccaatggtttggagtatcttattgatggtctttgccattattgccggaatcgttggtatcttattgataattgttggcttgtttcgaccagttaaagtcagcacgttgacgtatgatggcaaggttggccagttaacgattccgcaacgggctttggaacgtgatttgcagtaccgactcgttaatcagttgaatctgattgatcctgaggttcacttgaaattacggcgtcgtcgccgggtacgagtaaaaattgatgcgatggttaatactgacgcatcgttagaaaccacggcccaacaggcggcaaccttggcacaggactatttgaagaatcaattgggattgacggtcgaacaaccagtagtgcaagttaagccagcaaatcaccagcgtaagttaaccgtggtgtaaaggagggtcctgatgagtaacgcacagtatggttttctgattggactgcttttaggtatcgtctgggtattaaccagtttttcggcagtcttattagtcgcagttttagggctgatcggctgggcgattggacggtttgtccacgtcgatttggctgcagttagtcagaagttgagtgagtatttatctaaataatgggaggaattacaatggcacaaccagaacaacaattacagactcaattgacgtttgatgacggtgtgattgaaaaaatcgccggtctagcttcacgcaatgttgacggcgtgttatccctagaaggcggcatgttaagcaatttaacgaaccgctttcgtgatgaagctgacccgacgcagggggttgacgcccaagttggtaagaaacaagttgctttagatatgacgatgatcgttgaatatggtaaggacatgcgacaaatcttcaatcaaatttgtcaacgtgttcagcaagatgttgaacggtatactggcttgaaggtcattgaaattaaggtacatgtcagtgacgtcatgagcaagcgtgattggcaagatcaggccactggcaaaccaaatacggatcaatcaacagataagcggcaagttgaatagcacggtcgtttagagtagtcattggtaagacgatttttgacaaaacaaggaggaattttgatggaagcaacagcgacatctttaaaaccagaagttgtttttgacgatacggtattggcaaagattgctagtaacacggcccaagaagttgaaggagtattgagcttacagggaaatctgattgatgatatttccaatcgctttacggataaggatcgcccgcagaccggtgtttcagtggataccgatgacgatgaccagacggttggaatcgaattgacggccattctagcttatggtaagaatggtcaggagattctagcacgggtggcggataaggttgccaaggccgttaaatcaatgactggttatcaagtgactaagttaaaattagtcgttaaagacatgttaacgacagaagagtggcggcaacaaaatgacaagcaagaaaaagcaccagaaaagaaacatccagaaccaaaggatgacggcccacattaatggaagccgtaatggttaaaggtactcgcaaattaggcgggtaccttttttagtgatgagcgttacatgaagaagtatcctgaactaagttcgtaattgcgtttgaacgttcatgaagattgtccggaatgaccgtcacgcaactatcattattgttatgattcatgagatgagtgtacaataatattaatgaggtgattaatatggaaattggcatgcgggccaaccgaccgtttatcattacggatgaacagcatggacaaacagttttaaatgcgaagacagttttggaagcgctacatatgccagcagcggaccggcaacttggctcgcttgaaacgtttgcgccgcaagaattagcggcaccaatcacggccccgcgacagatttttgcggtggggatgaactaccgcgaccattcggcggagatccacattacgctgccgaaggttccaagtatttttacgaagtttagtagttcactggcaccagcgaacgtgaccgtggcgacgcatggtcctgagaccgactgggaaaccgagctagtcgtgatgattggcaagggtgggcgcgatatcgcgacggctgatgcaatggcgcacgtggccggagtgatggttggtgaagacttatctgatcgagccgttcagttcgagaatgataatccacagttttcaataggtaaatcgtttgaaaattacgcaccagttgggccgtggttaacgaccgtcgatgagttagctaacttagacgatgaggtgatcacgaccaccgtcaatggtcagacgatgcagcaagcgccgttgagccaactgatcttcaaggtaccggatttggtgcactacttgtcgacggtctgtgagttacaaccaggtgatttgatttttaccgggacgcctagtgggaccggcgttggtcgcaatccccaagtctttttgcaagccggcgatcaactgtgcggtcagattacacatttagggacgttaaatatcacgattaagtaaatagccatagtcggtaagtgagatgggtgaagatttatattgtaacgcccagcacaatgccgactttttttggtaccataaaagtaattattgaatagggggataccggtacgggaccggtgaggagcaacatgaaaaaagtgtgggtcggattattattaggaagtttattattagcgggatgcacgacgtcgcccaagtcgtcagcgcccaagacgagtcaaaaagcaacgtcaaccaaggtagcggcaaagcaggctgctagccaaaaaagtaccgctagcagtgattcttcatcaccggctgaggcaaccttgtggaatacgggcaagcaagcggctttatcaacgtttatggccgcttggcaacgcgagatgggccagacctatgtcgggacgtatgatgacaaggttcctgaccatttaggttttcgttttcccaatgctttgcttaatggtagcttagcaggccgaatcaagtggggctcgcagtcagtggatctcaagtggtccaaggacggcgaagaccgtagtgaatttcaagtggtggccgtcgcaacgggtggtaaggcggaagcacaatatccaaacacgtacttcttttgcctccatcatcggcgaccagtcgtctttgtgactcagacgaccaacggggacgagttgatcattcatgacacgcagaacagtgctttgcaagccggctttgccaagatcattacgggcagtcgaccgacgacgctgacagatagtgcgctgaacgtgaacatgagtcgtgatgcgaaggctaatcaatggcctcaaagttatcaggggacttggtattactataataagtacgatcacaagattaattcgatgacgcaaaatgataccgacgggttgaagctatcttatgtggcagctgagggacaaaaatggattcatattatgggggccgagcagactgctggggccggtaactttgaatacgtgcgttatcattattttgatggccgccaaattccagtcttaatgaatgctagtggtgctggggcctggttcgataataacgcctatccttcagcagccgcggcaaatcaaatgcgtgactggcaatatggagatgaatcaaagaccagtccggccgctgactcattagattaatcgagggtgtcatgatcggtagtgcgggcagggataaattaatcactgtgaaaatataatattaatataaaagccgggacaaatgcacgtaaattgccccggttttcattttgtaaagtttatgtatatattgaaaaagtcggaattgttttctaaaaataatgctatactatgacataagttaacggtgtcaagacatctaacggccggcgcattcatgtgaacggcacgacattttaaagctgattgtcgatcatgattgctgtcatttgggggaatggcgcgatgatgaagattaccgtcaacacaagtgtgtacgattggtcaaagagtaggaaatacaaagaaaaaaggtgtagacatgcagaaaaatacggaacacacgctcaaccttacgatgacgatgattttgaaaatcggcagcgcccggtcaatgattgcggctgccttagccgagattgcggcctatcgctacgaggcggcacgtgaaaaattacgtcaggccgaaactgaattgctaacggcccggcggttacaggtacgccgactgatcgagaatgccaaggctcaacggtttgtgcactcgacactctttatgaatgcccagtcggcattagtcaacgtgatgggcgagttacagatgactgagaatctgattggcgcttttgaacgctgggagccagaagcggcttaatacgaacgttaagctgacgagtgaaaggtcgcgtactggttcatgattagattttggaagatggtattcggtagcaacttagacggatagagatggggttaaaaaatgacagttacttttagtaatgaagatgatcacaagtttcataagcttactgaccaatgttttactgccaatcctaaattactgacaaaggcaaatatatcagtaccactaactacccgtaccattcagccacgccgttatttggtggtcaccaagatcaatcaggctaccttagcgacagctacgtggcaaccagtcaccggtgcaattgcgctacataagcatgaacgtttgatttatgatttgggagcgctatacgtcggccattttcaagttgccattgacgtggccggttcgccaatggacgcgccgttactgatgcggacaaggtttgccgaacagttgcaagagttaagtgtcgatgctagtcgcgtgaccagttggttgcccacagcctggattcaagacgacacgcgccatgttgaattattgccgaccacggtccaattcgaacgccgctatagctgtcgctacatcatgttggagccggtgggtcagtcgctgaagtggcagccggtgttgtcggatgcggagtttgaagaaattattgatgactttagacaagcggcgtaatatcgtcgtttacactaatgattatcgatatcgtacggtgcaaggaaccgtgtcatcattagtgatgggggttgtcgagaattagttgctaggcgcgtgacaaattcatgggcggcagaggacgcattccacccgcaattgtcgtataatgaatatattcttaaaaaacgaggagaataatatggcaaccacaactcatttttacgaaacatttcaaccagaacattacgatctttatatcaatattaaccgggcggataagctgatttcggggaagtcaacgattaccggggatgctaaggcgcaggaagtgctgattcatcagaatggtttgaccattgctggtgtccaagccgatggtgcggacgtgccctttactgtggatgatgcgattcaaggaattcgaattgaacttgccaaggccggtcaaacaactttgacgattacgtacagcgccaaattgacggacacgatgatgggtatctacccatcatattacgaagtcaacggtgtgaagaaagaactaatcgggacgcagtttgaaacgaccgcggcccggcaagcctttccgtgtgtcgatgaaccagaagctaaagcgacttttgatcttgccatcaagtacgatgaacatgatggtgaaacaatcttaagcaacatgcccgaagatcatgaagccgatggggtgcattactttgaaaccacggtgcggatgtcgacttacttgattgcgtttgcctttggtgaattacaaggcaagcagacgaagaccaagagtggcgtgaccatcggtgttttcggtactaaggcccacaaggctaacgagctcgactttgctctggacattgctaagcgctcaatcgaattttatgaagatttttatcagacgccatatccattgccacactcatggcaattggccttaccagacttctcagctggtgcgatggaaaactggggcttagttacttatcgggaagcctacttactattagatcctgacaacacggccctcgaaacgaaacaacgggtcgccacggtgattgcccatgaacttgcccatcaatggttcggtgatttggttacgatgaagtggtgggatgacctctggttaaatgaaagtttcgccaacatgatggaatatgtggcgacggatgccttagaaccagactggcatatttgggaaactttccaaacgtccgaagcatcaatggcgcttcaacgggatgccacggatggggttcagtcagtccacgttcaggtggaagatccggccgaaatcgactcgatttttgacggtgcgattgtctacgctaagggtgcgcggatgttagtaatggcgcgggccttagttggtgatgatgccttacgagcaggtttgaagcagtactttatcaatcataaatatggtaatgccaaaggtgatgacttgtggaacgccttagcggatgcttctgggatgcaagttggggacatcatgcattcatggctggaacaacctggctatccagtggtcacggcagcggttgttgacggtcagttgaccttgtcacaacaacagttcttcatcggtgaaggtgaagaagtcggtcgtcaatggcagattccgttgaatagcaactatgaggcggcaccagcgattatgaaggaccaagctgtgacggtcggcgattatgccaaattacgtgatgcgagtgggcaaccattccgcttgaatgttgggaataactcccacttcatcgtcaagtatgaccaaacgttattggatgatattctagcgcatgttgatgacttaacggctattgaccagttacagttgttacaagacttacgcttgttagctgaaggtcgtcaaatctcatacgcagccgttgtgccattattaagccggtttgcagccagccattcaacggtcgttaatgcagcgttgtaccaagttgcgggtaacttacgtaagtttgttacgccagattctgatgaagaaaagcatttacaaacgttatttgaccaattgagtgccgctcaggttaaacggttagggtggttgccacaagctggtgaatctaacgatgatcagttgacgcggccatacgttttgagtgcggctttgtacgccaagaatagtgcggccgtattggctgcccatgaattattcgaaggtaaccgtgataagttagcgaccttaccagccgatgtgcgggtcttcattttacggaatgaagtcaagaactttggtagcaaggacttattcgatagtttattgacggcgtcacggcagacagctgatgctagttacaaggctgacatttgtgacgcattgaccgcaactacggaccccaaattaatcaaacagttagttgtgaagtttgaagatgcggatacgattaagccacaagacttgcgggcctggttccgcggcgtcttggctaatccagctggtgaacaagcagcttgggattggattcgcgacgaatggtcatggttggaagccacggttggtggtgacatggaatttaccacttacatcaccgtcatttcacgggtcttccatacggctgaacgtttagcagaattcaaggcgttctttgaaccaaaaatcaatacgcctggtttaacgcgtgaaattaagatggatacgaaggtaatcgccagtcgcgttgccttagttgaggatgaacgtgatgcggtgaatgcagcggtcgcggaagttgtaaaataagttaatattcgttataaaggtagttcggtgctggacgtttcagcgcgggctacctttttagtttgcaatcaaaccatgtttaatttattgccaatgatttaataattgatagaaataactaacactggcctacagcgtcagttaaatatgatatgatattggtaattatggagagtagacttgattagtattacggctaattaatagtcgtatagatgggaggacctatgatggcaagtggacatcaatctgaggcagaattagaaaatcacctcattcgaaagttacaaagcattggctatcattacgttgaaattcccgatgttgaaacgctaaacacacattttcgtgcggtcttgagtgaacgtaatcaagaacgtttaaagggaacaccactgagtgaccgtgaatttcaggccgtattaaatgatttgattggcgctaagacgcattatcaagttgcccaaattttacgtggttcggttgttcagccaactgggaaaattaatattaaacgtgatgatgatagcagcttatacctagaaatttttaatggaaaacaatttgatcagaatatttttgaagttagccatcaaatgacggttgaaggtcgtcatgagaaccgctatgatgtgctgatcttgatcaacgggatgccaattgcccaaattgagttgaagcggcaaggggttgaatttactcaggcttttaatcaaattattcgctaccgaactgaatcgtacgcacaagcaaaactcatgcgactggttcaggtatttgtcatttccaatggcaatgaaacgcggtattttgcgaatggcgatggtgagttaaattcaaacttcatgttctactggacggatgaacataataattggttgaatgacttggacgcttttacgaccactttcttgagtaaaccacggttacatagtttaatcgcaaaatatacggtgttcgatagtagtgaccataaaatgttattaatgcggccttatcaaatatatgccactgaggcaattattaagcaagctatcgatcacccccatgaaaatggttatgtgtggcacacgacgggttccggtaagacgattacctcctttaaggccagtcagttgttattacaagaaactgatgctgaaaaggttatcttcatgattgaccgtgccgacttggatattcagacggtaaagaattttagtgcctatctgcctgaaacaactgggggccagagtcccttggatcggactgacaatactgctgcattagtcaagcagctgtcctctaatgataatggcttaatcgtgacgaccattcagaagatgaataatgcggtctctaatgatcggtataaagatattctgacaccgtaccatgaccgcaaagtgatcttcattgaagatgaaagccatcgtagccagatgggcgaaatgcgaaaaaacgtgaatcattggtttaagaatgcccaacactttgggttcactggaaccccgatttttcaacagaatatgggacccgatgggcggaccacaaaagatctgtacgagaatcagttgcatcaatacttgattcgtgatgcagttcgtgatggtaacgtgcttggtttttcgattcagtatctgtcgacctttgaggagactgatcatgacattacagacgaacaagtaccaggaattgatacgcaagaggtctatgagtccgaggagcgattgaccaagattgttgagcatatcctgttgaaccatagccacattacaaagaataagcattacaatgcaatctttacggtagcgaatacgcgcatggctttaaagtactatcagttgtttagaaagttggatcctgatcataatttgaaggtcacgacaatctttacgtgggctgccaatgaggacgacaacgaggaacaccaaaaacaggatgatgtcacttcacggatgggattagatcaagtcgtgaaggactataatcaaatgtacggtacggatttttcaacggataaattcaaagattattttgcggatgtttctaagcggatgcgcgatcataatgaccaaacgccgacggataatattgatattttgattgttgtgaacatgttcctaaccgggtttgactccaaacggttgtccacactatacgtggataaaaatttgcaatggcacggtttaatccaagcattttctcgaaccaatcgtgttgagggcaaacaaaaaccattcggaaatattattgcttatcgaaatatcaaaaataagacggatgaggctgtagcgttgttttcagacggggacagttccggcttcttagcaccagattatgatgaattaaaagctgaatttactgacaagattggccaattactgacggtgactccagatgtccagtcagtggacgacctctataaccgaggcgatgacgcactatatgagtttgtgatggcgtttcgggcggtcctccgggtatataatcgtattcgcgtgtatgatgattttgaatgggcgcaatatgaacctgaattttcggatcagctgatggaagccttcgggggcaaatattttacggcttatcaaacgatttaccaacgtaaaacgcaggagcgcgtctcaatattagatgacgttgactttgatatcagtctattggagactgataccatcaatgttgactatattgtgaacttaatctcaggcattgacttaatgtcgtcgaccgaacgtaagcaagatattcagaaaattgaacatttgttggataatgcgaccaatgaccaattaaagtcgaaggttgaattgttggaacaatttttgaatgaagttttgccaacgctcgatacagacgatgatatcggcatgtcgttgagtaactttatggccgagagccagcgagctgccattaagggcttttcacaagaacaccacctttcggaagacttcgttaacgagcagatttctgactacaacttctacggtaagaccaaggacaaagagattattgacaagttaagtgctaatgggctcggctttcgagagaaacggcaggccaaatgcgagattaaggattttgtatcgactatcgaccgaaagtattcactaagctaggagaatgaatttaatgagtcatattgaacaggccgaacaacaggctgaactacaaaaaagattatgggctgtggcaaatgatctgcgcggtaacatggatgccagtgagtatcgaaactatatcttaggattaatcttttatcgctttttgtctgaaaaagttgaaaattacgcaaatgagttacttcaagacgatgatgttgactttgcagatgcggaacaagatgctgacctgatgcaagatttgaaggatgaagtgattgacgtcttaggtttcttcattgaaccacgatatctgtttacaactatggtcaagaagattaacgctggcgattttgacgttgaaatgttacaaaatgccatcaacgaagtccagaattcgactttaggcaaagagtcagaaaatgactttaaagggctattcgaagacttggatttgcagtcatcacggttaggaaatacagttgccaagcgtagtgaactgattgccaaagtgattctatccttgtcgaatattgattttggtgaacaagatattaaaattgatattttgggtgatgcctacgaatatttgatcggtcaatttgccgcttcggctgggaaaaaggcaggcgaattttatacgccacaacaagtttctaagttattggcaagaattgttacggccggtaaagatcgtttgaagacggtttatgatcctacgatgggctccgggtcgctgttattacaattgggtaattacgcaacgattggaaactactatggtcaagaaatcaacggtacgacttacaacttggcgcggatgaacttgttgatgcatgaggttagttataatcggtttgatttacgtcaaggcgatactttagaggaagatcactttgatgatctaacttttgacgctgtcgttgccaatccaccttattcggctaagtggaatccagatgataaattagatgatgaacgttttcggaaatatgggaagacggcaccgaagtcgaaggcggattttgcgtttgttgagcacatgctctatcacttaaataatgaaggcacgatggcagttgtattaccacatggtgtcttattccgcggtgctgcggaaggaaagatccgacagtacatgattgaacatgacaacgtcttagatgccgtcatcggattaccagcgaacttattctacggaactagtattccgaccgttgtattggtcttcaagaaaggtcgcgaacgtcaggatatcttctttattgacgcgtctaatgattttgaaaagggtaagaaccaaaacaacctaacggacgaaaatgtcgataagattttggaaacccttgaaaaacgtgaagatgtggataagtatgctcatggtgcagaagtagctgagattgtggaaaacgagtataacttaaacattccgcgatacgtcgatacattcgaagaggaaccacctgttgatgtggataagttggttaaggaaatgggcgaagcggatgccaaaatcaacgacctacaatctgaattatccggaatgatggccgacttagtggcgactgaccctgtcgctcaacagcagcttgaggccattaagaggatgttacaatgaaaaacgaaaatttagtgccaaaagtgcggtttaagggctttagtgacccttgggagcagcgtaagttgaaattattagctgacttttcgaagggagccggctattcgaagaaagatattatagatcaaggtacacctattgtcttatatggtcggttatatacaaattatcaggtgaatattactactataaaagatacttttgtgaaagtacgtcctggttctgtttttagcgaatgtaatgatgttattgtacctgcttccggtgagacagccgaagacattgccagagcgtcgcatgtatgtatctctggggctgtcttgggaggagaccttaatataattaagcccaaaataaacattattgatagttcttttctggcactttgtatttctaatggtcagcaaaacaaagagctaattaaaagggcacagggaaaatctatagttcatttgcacaactctgatttgaaacaagtagtattaaaatatcccagcaaaagaaatcaaagtatgatagctcctatttttgataaaaccgacaaccttatcgctgccaatgaggataaactagaacagttaaaaactctcaaaaagttgatgatgcaaaagattttttctcaggaatggcgcttcaagggattcactgacccatgggagcagcgtaagctttgtcagattgcgaccattaatccgaagtcagttatttctccgcattttctttatgtggatttggaatcagtaagtcaaaatagagtcacacagtataaagcagtgacaaaagatgatgcgccatctagggcacaacgattagcaaaaaaaggcgatatttttttccaaaatgtaagaccatatcaaaaaaataacttgctttttttgacaaacaaaaataacgttgttttttcaacagggtatacacaaattagaaccaagcaagatataagatatctattttatgcattacagactacgccgtttgttaatcgaatacttgctttatccactggaactagctatcctgcgattagcagttcaaaattagccaatgcttctttgctggttccaattattgacgaacagtctaaagtaggattatccatatttaaaatagacagccttatcgctgccaatgaagataaactaaatcaactcaaaaagttgaagaaatatttaatgcaaaatatgtttgtttaaatttatggattttttacgggctatccctgctgaatagcgatagtattaatttatttgtaagtgtcaattttagccaaatgaataattattcatgtataaatgagttagcggctgcacaagtggttgttaactcattttttggaggtttcttatggcacagcatgttaagtttcatcagtatttttttcagtggatgcagctctataaattagatgcggtccgtccagtgacttatcgcaaatatgaaatgtcacatcggcaattggtaacgttagcgccggatctaaagatggctgatttatcaaggctgacatatcagcaattgctcaatgattatgcggaaacccatgaacggcaaacgacaatggactttcatcgtcatttaaaaggttcacttattgatgcgttggaagaagggtttatcgatcgcgacccgacacggaaagcaattatcaagggaattaagcatcgtcagcataaaacaaagtatctacatcagtatgagttgcaggcattgttaaatgaattaaacctgaacaacgaagtcaattgggactacttcatcttgctgattgctaagactggaattcgttttgcagaagccttaggtgttactcctgctgatttcgattttgctcaccaaacactttcaattagtaaaacttgggattataaatctgccaaaagtgacttcgcacctaccaaaaataactcatcagtccgtaaagtaccgctggattggcagactgtgattcaattttcccagttgactaaaaagctgcccgaagatcaaccaatttttgttcaagcaaaagtttataatgatacggttaatcattatttggagcgtttatgtaagcacgcatctattcctgtgatttcagtccatggtttgcgacatacacatgcttcattattattgtatgctggtgttagtatcgcctcagtagctcgacggttaggtcattctaatatgacgactacacagcaaacttatttacacattattcaagaattagaaaaccaggataacgacaaggtcatgaaacatttagcaagcctaatatagacaataggatttacgttaataagtgcagattcaaacgtcctcgaatgttgagggcgtttttcagattatactcattggcagcgataaggttatctgtttttctaaaaaacttagctattttcatttgttcagttgcaattggtacttgtaaattaatattgaaaaacgcatcaaaactaatgtttaacaatccatccattcttgcaccagatgaaactaattttctcaattcacgatttggacttcctgttgcaaacaaatactcaatgaaatctgccgaattattatgtttaactgtaaagctatgataaacacgtggaactaatgcttctgtatagatatcaagcttgaataccgcaccatactttgcagttttagaatttccatgattatatgacaattgtcccttttttaataaagtatagtttttttgttcttttccagcgatattttcagaaaatcgatctttctgattcagccatccttgtgtagccgaaattgtgagagttggtaattccattcttccgtcatttccccgaactcttatggcgatattctttagcttacgctgctcccaagttttcaggcttatcggtcatatattaggaactggtacttgggagcagcgtaagctaaaagagataactagtgtaattaaggatggtacacatggtacacatattgagcactatggagcttacctgttaagcgcaaaaaatatcctatcaaataggattgtctacagtaaaaatgatcgacaaattagtattaacgattttaataaaatatacaaagggtattcattaaatgatggggattttcttttgactattgttggaactatagggcgcacagccatttatagacagtccaaagataaaatcgcttttcaacgttcagtagccataatacgtggaaaagaagaaattatagataattattttttgatgtttagctttcaattgcctaccataaaaaaaatattgcaaagagtaacatctatttcggcgcaaccaggtatatacctgagagatctttcaaatatagaagtatggtatccagttatctctgaacaacagaaaatcattgctttattaaagaacatatgtaaccttatcgctgccaatgagcaagtcccaaagttagtcattaaaatagtaaagaattttctagctaattcattgcatttaaactaatggttatgattagatatggggcatttagcgtgagtgaaatgagataaaataatcatcttaagtacagtttgaaagttggcttcaggcacccggagagtataaatcaataattatgccacatttggtttaatactagtataattatcaagattaaaaataattatgctgatttgtgggtgcttctgcattatttgaataacaaccgtagaagcagttttgaaaaataccaattcgcaagccaagcaaaaatgccaagttgactagctcataatctggttaaccatagcaaatgaagtaatgtttccctaactacctaatcaaccgcaataacacgcacaccacaataatccacgtctttctgatcgccaaactgccgcatgacctcgccgtgcgtgacgcaggcgatgcaatcgtaagatgcggcatacttattcaaagttgccaaaactcgggtcttcatttcagctgccgattcgtaagggaggggactagcggtggtgcgtttgccggcgtgttggcgatagagcttgtaggccgtggccgcttgttcatcggtatcagtccgactacccgtgttatcgggcagccactcgtgtaatccaaggtcgacctttagtggaatatcattaaaacgcacgatttccagtgccgtttgtaaggcacgcgtgtagggtgacgacagaattaattggacttgtgcaaataacggctgctgggcgcattgttgtgccagcataataccacggtcggttaagccgccgagttcacggccgaaaccagttaatccagctgtagtgacctgttggtaagttggttcggagtgacgaatgagatagactttcatcgattaggacttccttcattggaattataatgattaatttcattataggcacctttgatcagaaaaaacgacacttcatttttcgaagtgtcgttttcgttagacctaatgacgctatgattgccgatgtttaccatagaacccgaacgtgacgacggataataacagtcctaggatgaccgctaatttgccagtctgttcgtcggtttgtggtaactgggctgagtgttcagtgacgggactcgttgttttgaccaaacttgcctgggcggccgcgggtttaagcgctggtttcacggtcgctgctggttttacagctaccgctggttgagtcggtttaatacgatccggctgcgttacggtcgttcctggttcgttaggcgtctcgggtgtggttggctcaaccggcttagtcggttgttccggttcttcgggatcaataatatcgtcggtaccagtcgtgtcagttgcttggtagacgtacgtgacgtccacgttatcagcagtgaagagacccgtggcattttccggctgaccaacgagttcatgatcagtgaacgtcaggggcacggtttgataagtggttcccgtcttgccgctcagcacggttggttcgtttagtttaatgccgtccttggtcacgtaatgcaccgtaacggttccttgggtatctggaatcgtgggggtgttttcagtgtaaacgtaggtcacagtcttcgtggtagttccgaacgtcccactgacgtcaccctgcacagccttgaaggtgtaaccatcgataaccagctgtttagtcgagtagctgtcacccaaataaccactgagaacaacgtcaggatggatagacttaccatcctggtcctgatacttgacagtgaccgactgtccagccgtccgttcgtaaatgtaaacgacgcgttgcggctgtacagtataggtcccagtcgtgttaccttgtgtcgattttaccgtatagccgttaatgttcagcggcgacgtttcatagggttgtcctaattgaccttggccgcttaatacgctatcggcggctaactgctggccgttttcgtctaaatactgaaccgtgatatcgcccgcatcttcacgagcgtagacgtagatgacggtttgcgcttggtcgctgaattgtccagttgcgttcgccggcgtttgaattaagcggtagttttcaagcgccttggcgctagtctgataggggcgaccgagctgaccgtcaccagttaagacgtcgtcgggagctaaggtcgtgccgttagcgtcttgatacttcaccgtgatatggccggcattcgaacgtgcatactggtaaataacggtttgcgcgtcggttgaaaaggtcccggtggcgttcgcaggtgtggcgactaggtaaaagttaggaattgaaatggcttccgtttgataggctgctcctagctgttctttaccgtctaaaagcttgtcgggtgctagtgggttaccagcactatcttgatacttaacaacgatctggccagcatcgcggcgcacatagacgtaaatgaccgtctgttcctggtctgtgaaagtgcccgtggcgtttgtcggcgttgtcgtcagggtgtaattttcaatgtccaacggttcagtcgtataagcctggccgagtgattgggagccggaaattgtcttatcgggttttaattggtttccttgcttatcttgatatttcaccgtaatgttaccggcgtctaagcggacatagacaaacgtgatgctttgcggatcagtcttgaaaacgccagccgcattgccgatagtttgctgtaatttaaaatggtcaaaggttggcgcatctaaattgtaggcgttaccgagattgtgttttccaggtagaatttgcggctcgtagactaagttgccgttagtatcgaccatgtgaatcgtaatgtcgccggcgtccttacgagtatagtaataagtgacggtctgggcatccgccgtgaagacgccactggcattgccaacaatgttcgtaaagtcataatttggtaggtcgtcatcaatgcgttgagtcgtgtaaggctgaccgacgatgccgtttaaggtgaggtcggtggtgactaaggattcaccggtaagcgcgtcgacgtatttgaccgtgatgggcgcagcagtggcggctaagacgtacgggcggacgacgacaaagttgttaccgtcagaagcggcggtcatgaaataataatcggccatgggaataaccgtggtaccgttaaagttcggacctgttattccgggttgctgaggcttcatattcgtgtaatagatatgaccgttgctgtcgtaattaccaccgcccgcaccgttaaagtaccagcgaacgtaaagctgaccgtttttgtagaaaacagtttcaccgacgccattattgggcttcagttgaaccttagagccatctggcaaatagcaatcaatcgccagcgtcgcaatattattatctgcactaatataggcgggtggtaaggtgataaattggttactgaatgtgcctttcagatttttaaatcctttaagtggcgaaaaatctgaaatgtggttataggcggcatcgacctccgttaaattctttaagtttgcgagcggtgaaatgtccatgatccggttttgctgaatattgaccacttggagtttttgtaagttggctaatggtgaaatatcagtgacatcactatagtaactgccagacggtgcgttcaagttgttgttgagccagactgtcgtaaggttagtggcatattgcagtccttctaatgagtaggaagtcttgccgtcgatataagtgtccttgccatagtaggtggtcagtagtagcatatctgccttagtgatgtctgcagctgagttccaggtacgatctgggttctgtttgcgcagttgactgagtacctcttgttgcaataacgtgttcggcatccaatcgttaatattttctgacgcggtgcggctaatggcacggacgactggttggttagttttcaaaaccagcttttcctggtttacattggtaacaattttatcatcggttgacgctgagctagtcgctgactgagtattcacctcggtggtagtggagttggacgacgcgggtacggcttgctggcttggttgcttggaagcttgattatcggttgtcgttgctttagcttgactatcagtcgctgattcagtgtttgattcggtagttggttcagtagttgatgcggaggctgtttgagctggtgcggtttgagttgggtgcttaatatctgtggtcggtgttgattctgacgtggtagttgcttgagattgtgatgctggatttgctgattgttgttgtgggttggtgttcactgacgacgagtgctcagagggacttccggttgatgtggtgggtgacgtggctgcgactgctgactggtcggattttatcgtggatactgatgtagaagtatccgctttcaaattgacctgagtagcgttaacttgagtattcgtattcaactgactgttggtcggttcgttggttgtggtcgtgactgtatcgtcggcagccgccgcctgactggcaatcgttaacgttgtcagtatcatggcggttgcgctcgtgattacccatcgcgattggtgacgtttattctgattattaacattgtttggtttcaaagatccccactccttcaaaatacttatataatgtcgttgacaatttaagggtaacattgtcattgccgttagtctaataaatgataatttaattattgggagctaattgtatctgtcaatgtcagctggctgcataatagttgacgtaagcataagattgattataatttaaatggtaataattactgtttatcaggaggcacccatgatggaaaaacaagatttagcaagtgcgcgcaggcgtctacgggggaccaacttaaaatcgcggaaacgcgcattgaagattttacatgatgcccgacgtaacgccagtaaagccaaatagtatcagcgaacgttagccaatttggctaacgctttttgttagctgtgcggtatgattaagatacaggaatgagtggaggacatgtggatggaaacaactttggtgattattcggggaaattctgggagtggcaagacgacgctagcgcaggcgttgcaacgacgcgtgggccatcatacgttgctagtgtcccaagatgtcgttcgtcgcgacatgctgatgagtcatgattacccgggaaatatttcaattggtctgattgaataaattgcgtgttatgggctgggacgtgtgcctgtagtcattgtggaaggcatcttagcacgtgatcggtatggaaaaatgttggcgcggcttagtcaatcgtttccacgcgtccttacttattattttgaagtgagctttgccacgaccttggcgcgtcatcaaaagcgtcatcgtgattttggtgtggaagacatgcgtcggtggtggcttccacatgatacgttgggcgttgctaacgaagtcttaattggcgagcaacaagatttaaccacggaagttcaacaaattatgactgccatgcatgattgtgactaaacaaccatgagttgattggtttgatcgtggttgaagattaagctgaaatcataaagggggcgagccaatgttactcgcagcattattgaaaacgcgtcgttgtcagtatggattgacacaggcacaattagcgtccaagttatttgttacgactcaggcggtgtctaagtgggaacgcggaaaggcgattccgtcaatcgataatttactggcactgtcggatctgtataatctatccttggatgaattagttcgtggtagtgctttttttccaaaaccatatattgttggtcgacgactaagctttgggcgacttctgggtctcggattattttggctatttgtttgtctattatttactggttttggttatcagccgtggtggctctttttattactttatattgttggattgattgtggtcgttccagtgggaatcaatagttactgggtgattcagcctgctaccgttgagttgcatacgtatgctgcatcgacattgacgaagtttcgccaaattgtgttcaattgtccacggtgccaactaatccactatacagatctgcagcgggttaccatcagttatcggtgtcgcaaacgactttcaccatttgatttcaatccggattattttcaattgattttaaagactaatgcccaaacttatcagctggaatgtgcgttgaaggccagcgactatttaccgcaatttgtcagttatttgcaacgacaaggtgtgacggttgatgatcctcaacaagttgtggaattgttagtttcaggaaagtcgttgtatcaacattttcataccgagacttgatcttgagtggttgcaaccaaccgttgcggtagcgcttaagtgtgttgcaatgaattggtgcacccaatagtctagtattttaatagaggagcgggtaggatgaaaattgtgattggtactaaaataaatgagcaacgacaacagcatgaatggtcccagcagacggtggcggagcggttacacgtctcacggcaaactatttccaagtgggagttagggaaaagttatccagatttagagttgttggtagcactgagcaaactatttgctgtctcgacggatgagttattaggtttgagcagaagacctgttcagcgaccatggtggcagttgttattgcgtaaaaggagtcgaacagatatgacggtgaaatggtacagcggggggcaggatcgggcacgtgttgctgtgggcataattagtgatttagttgctaatctaaataccacgaatgagcaaccgttacgacagctgctggcaacttattatcaggaactattggaacaacgaactggttcagtactgggagtattcgacagaatgaacttagacatctccaaatgtctgcggcagcaacaaatcaaactatcaccagaaaatgagcaactaatgcaacagctggtggggttgaacatgatttactaccggtgatttattttgaaagtaaaacgcaaactgtcaatcatctagcttaatagatgctgacagtttgcgttttatgttaaaaatcaatcgcagggttaaaggtttgacaagcttgttcgactagataagcaatcggtttagctagcacgtgacttggtaagtaggcaatactaaaatcaaggctgagctcgcttgttggtaatttgaacgcattgatagggtacttggctggttcagtggctagtcttgccaacattgcagtggctagaacaatgctaccaagtccttgaagtgtcaagcttagtgcaaagcgagagttatcgacttcaatgagtggaatcgtttgaatgcctttatcggcaaagtaatggtcaaccagttcttgaaagcgagcttcaccgactgcacggatgacaggctcaccggtcattcctgtaagaatggtgggggtgaacggtcgccaaaattgattggactgatatattccggctgtttttggaatgactaaatacaaagaaattgtctgcaaagggatggttttgacgttagtttgatgaattgttttgccaataaaaaagtctagctgatgactagctagcaacgtttctgcttttgatgttgtgatttctagtattttagtgcgaatgttcggaaaacgttgataaaaagcaggtagtgtttgactaaaccaagcattagccatcggtggtgtaatcccaatcgtcatactttgatacttattttgactgatttctttaagctcagtgttcattcgctgatggagacgagcgtcactttgcaaataagtcagtaatctttctccagcataagttaattcaagtggatgatagccgcggtcgattaagggggtcccaaaatgagtttccgcacttttaattgtgcggctaatgtacggctgactgatgaataaactttgtgcagctttcgtcatactattgtgctgttgaatagcttctaaaaatactaacaatttattttccatgaaatcgccacctttaatgcttaatcttattaaaatcaagtataacccattactcatttgtaataacagataatcagattgttatttctataaaaatgaaagcggttatataatacagatgtagttaaaaaatgattctgtttgtgatttaaatatcaattttaattgtgctttagaatacgttaaatggattttgaaagggtggtcagcatgctcaaaaaaatgaatcaggttaaatgggattatcaatatgatacggtagttattggctttggtggtgccgaggcgacagcagcgcggtttgcggcggatgcacatgcgaaggtgttgctcactgatgcagcgccgaatgggcatgaaggaggcaatacccgttattctgcccaactcttaggaacggtagatagtttcgatgagggtaaaaaatattatcaaaacttaacggcacccatgcaattagacgatagtatggttgatactttcgtagcgggcatggcgaatatgcgcgactatgttcaaaagtatctcaatgttgacccggtgagtgtcaaaaatgattttacagctgctgattctccaatttcattagacagtgcagttcatgagtttcctgaatttgatggagtccaatcctatgactttacaactgtccatcatggcatttttgatgcagctttgtggaaaattcttcgacaaaaagtgttagatcggcagcaacagattgatgtctggcttagtgctccggcacaacatctgattcaagatcccactacgaatacaattatcggtgtccaaatcgaacgtcagcatcgtttagttaatgttcgagctaccaatggtgtagtcctagcatgtggtggttttgaaaataatcaacaagccatccaggactaccttggtgctgagcacttggcaccattaggcacgctgtttaataagggtgctggtattaagatggcccaagaagttggcgcggacttttggcacatgcaaaattatgaatcactcggatttttacatggtctttcgattgccgtaccacaaggtgaacgtggtcgcttgattttaggctggccggaagttaaccatggtagcgttattacggtggctgatgacggtagtcggtattttgatgagagtgaagccaaccggcacggtcacatttatgatcatggaatgtggcgagtaccgcggacaaatgtccatccatacctggtttttgatgagactcagtatcaacagatgttagcaagtcaatatacgccgattaataatctcaccgatttagttgtgaaggccactactctaaacgacttagcacgagttatggaagttgatggtacggtacttaccaagaccgttcatgatttcaattattttgtcgagtctggtactgactacgcgtttaatcggcaggttgatacgatgcgggcatttgatggtgggccatattatgcgcttaagttaacaaacaacgtacttaatacccaagggggaccacgtcgtaatgaccgggcagagattttagatgcaaatcagcaacctattccgcacttgtatggtgcaggtgaattgggcggtatttgtgcaaatcagtatcaaggtggcggtaatttagctgaatgcctgatttttggaaaaatcgctggtgaaaatgcagctaaacctaaggaagaaacgacacaattagtcgatgaaaaagcagtggctaagccggatgcgaatactagtgcttcggtgcatcagactggtgccaatgatttgctagctgaagcatcaccggacatcacagttggtgaacaccaatacttagggcgctcagatgatggcattggtgggcaagttgtggttcgtatcacgtatgttgaccaacaattaactcatgttgaagtagttgaacaacatgagactggtgaagttggtggtcaggcagttgccgaattgccggcaaaaatggtggctgctaacacttatgatgtggatgcagtttccggcgcttctgtatcgagccgtgccatcaaggccgcagtcaaggacgcgctatcccaggccgaacagaccgtgtcaaatgattaaccactgatcgcacaacccacgaatcacctagtgcttttagtatcttttagtgcgtaataccggtaaactagaattaacaaattcaatcaatggaggccgctcatgcgtattacaaaaacgagtttgctcctcagcagtttatcattggtactcaacacgttgtcattgattatggcaattcgcaagtatcgattacaaaatcactaatcattagaaattcaaaaacaccgctgtgactaacgaacgcggatatactcctctttgggtagacaagcaaataatcaaagcttgcctacctaaggaggagtttttctatgggcagaaaaggttctcgctatacgatta

SEQ ID NO: 20 - DNA, 27779 bp, synthetic construct
  source 1..27779: mol_type = other DNA; note = Lactobacillus plantarum PDG8 - contig 20
gttttctgtggttactaaatatcataagggaaggcattccctatttctatacaattcagaaatcttttatgcatttacacaagatattttacgctctctaatcttctttattaatccccttattaggtatgaataccgctaagttagtattttttgctttgaaatagttaggagatatatcactagcacccttaatcaaaggatataactcatcagtttcaacccaaacctttcgggcaggaccaatatcggtacgcccagcttccggtctagtccttacctgtgccaagctactagccttattaacagctaacacctctacgaagtatataccgttaatgtctgcagtaattcctttatatccacgataattactagtccctctcaagacttgatatgattgtaatttttcttttgaaccatatacccatggtgatctttgatcaaatataggctgcgcaaactcttccgtaacaatgcgcttctttaaaatttcggatagttttgtatttttgtttatcgattttttaccatcaacagatttccattcaacatagggtaccgggtatttaatcgtatttaacgtttttctcagtcctaatagcatggtcttattcaccgcatcaggaaaaggttttaatgcttttaaatcgtcaacaaacatgggtgccaaagtatagtcccctaattgaaacattctgaaaccggaagacgaatcattttgaagatgattttgtggtagtaaaaacaacaatataccatcctcgtttaaccatttatctgctaccgtataagttataagggccgatatatctagctcatttccaccatgacgcttgtgttctgaaaaaatattatattggatcgccgttggtttcacacgctcacgatataattccggtaattctgaccagcgaacccacggcggattacctactaccatatcaaaagtaccagtttcagcagaccaaaagaaattttttatgatttgaaaccaaattccattccagttttgctggtgcaacttcaaaacattattgtaagtttcctcaatcataacaaacgaatcatcatttttaagaaagggcaatgacttaaacagactctccgaaacatctgaaaactctcggccatcatttacaaacatatctagtcgttcaaacaactgcttaatacgtgatctatgtctagcaatataacccggtaattttaccgttaaattcgcagtactagatccaatctgatatgtgaaaatatcattttcaccttcagtcggcgcataaactgcatcagacagtagaataggaatctcaatactctctcctggattctctcttattaaatcaataattgtaaataagtaatttaccctgcctgtttgcacagccaaaggattcaaatcaaatccataaacttcttttaaaatatttttcaattgtgttttatgatcaatgccttttttatcccattcttttctttttatattaataacctgaattaaaaaagaacctgatccagctgttggatccaaaatcttactggacattatttttgatttatcaacttttgatagcgtatactctattaaccaatccggagtatagaactctcccaatgattttcttaaagaatctggaactaagccctcgtaaaagcctttcaatacatctccagattccatagcatttttttgatcaaggttgtacaaagttaattctgctgccattcgttttaataaaacagccaagtcatcattttttgcatagcttaacgatgtgtaccaactaaataatacttcacttacaaaatcgtttaattgcgcttccctaaaatattggctaagctcaatttctttacgtaaactatcaattactttatcatcactcaaagaaacgatatgctccgcataatggctaaaactagagatattgaacgtagatactaactcggcagctaataacttcactaataacgaattatacgtattgatagtgaacagtgattgagacattttcgcatcatccggaaatggaagattcttcaaataacttttcgccttccacatagccggttctgatacttgtccatataattgtttccattcttcataaaataattctgttcttgatccactaatgctcagctctttaatcaaaatattataaagctcacttagaatagcttttccaattggcgacttaggaccaaaatctataattaaattttgggcacttaatcctctccgaaattcggtgttaatagcctctataaccaaattaaagctgtctatgtttgttcgcaataaatttccagtctccgtactaccgtcatcatttactttaacaaaagcaatatttactccatcgataacaattccaataaactcatgtggtaataaatttctgcgttcactggcccgtaagacatatttttttattcgattatcaacagcctcaataaacttttttgattttttgctattatgaaataatcctttattcttgaattcaataaacacattattgtatgacatatcacgtttgtcatgctcttgttcaaatattttacctgttgcacctgacagcgcagcaccccaagccatgcgcacgtcttcctcttcagttgcaacatttaatttcatcatcatttcgtcaaatatctctttgtatttttgcattagcatcctcccagacagatttgttagcttattaattaaaagggattgtaccaaattatatactaacactaacaaagaacgtacgttcgtattaacactcacgagcttgttatttctagaattttcattaattaaaattcgacttctacattttatagttatttaccgcaattagcaaaaaaagataagtcagtgaccattactggcctatcttttcattactactactcagcaatcaccttcaatactttcctagcctcaacatccacttgctccggcaataggccaatatagtacttttgagtaatcatcacactggcatgtcccaaatacttcgacacatacacaattgaaatatccttactagttaccatgagactagccaacgtgtgtcttagtgtatgagtactaaactttggcggaagacctaacctcttctgtaattgatgataggtctcattaatatttttcgaatttggcaatatcccatacttatttaacagaagaaaatgatctggatttttaataccgcttttaaatagaacctgccgatggtagtgaatccaacggtttaaaacattcaataccgcattcggtaaaggaatagttctttcagcatggctagtcttagttccttttaaaactagatgttggctgtcccaagactcatctacacgtaaagtacggtgtacaaaatcaatgtcttcgtattttaaggctaaacattcgccaacccgtaaacctgattgcgaaataatcattaatacgaggcgattcacatctgccaaaaagtaatgatagcttagcagaaagtctcgaatcttcttaaaactactaattggcataaacttcttatcatctggcttagttcggcttggatcagcaatgatttgtagcgttccatcagccggattacgagctagcacgccatcgctaacggcatcccgcatacaagcccgaatatgttgcaaatccttacggcccgtttcatgacttaatcccagctgatttaaaaaagcctgaatttggttacgagttacgtcttccatcttcactcgttcaaagaatctctcgtaatgactgtaactgattagataggtctccaaagtatttgggctcacaactggtcgcttatatagatcgacccaatgcaagtaataatctaagaagcgccagttagccatttcaaacgtagttccacggtcataatcaatttccatttggtgtaaccactgtttagcctgagaaatttcattaaaggttttagtcttacgtcgtcgacttccacccgagcccagactcaactcagctttatattttcgtcctttcaatggatttaaatagattcgactcatgctggggcctccgtttcattaggaaccacttttaattctggcttcacaggtaacttctctggtttagttgtatcttcatcaatagtcgttactggaccgaactcccacggcgcatctctcaacgctaatggatgaacctttttaccaccatcatttagtagccaaaacagctttttctgttgtttttcagctttacattgatcgatataatcagctaacctaaccgttgctacttcatactttgtggataacgagccagtagcaaggatcactttatccacatgtttagtcgcagccattaattcttcaatcccatccggtgccgaagcttcgtctaaacgcttattgcatggccacttaacttgcgcattaaataggtttgcaatcacaacaccaccaaaagttccacgatccacaatcgcatttcgaatcaagataccagtcaaactatccttcattacagaaccggtcactgggtaattagctaataccataactagtggttcatccttgttccagacccacttcttccagtaggtgaactcacccttgatcttttgttccacagtaacgtttagtttctccatatgcttacggttcacttcggccattatttaatccctccaacttcatctaataacttagtgactgcaacgactgttacttccaaagcaacttttatccacatgttcattacttttcctccgatttttttgcacaaaaaataccaaacagcttgtaaactgtttggtattacatttgaatattattatttaagctatttccaactaccagtttctccttcaaattgctcagcttagtattgagactctttgcatcattcgtaacttttgtcccggtagtcactgttgtcacagctttttgaacctcaccatctttaagctcagattgtgtatctaaataggcctgagtctggtcacgataagccttagccttgctgtcctttggtttttgcgtcaatgcattatcaaaataagttagtgccttatcaaacctattttcagcaactgcattaagccctttgctgataaagctattgtatcctgaattcttattatcagctgactgttggttaccacatgctgcctaccaactcatccaattgccgatagattggctgaagcgcttcaatatccattggttctaccattccactaccccctattaccgctagaagaatcattgagacaaaatgtcccaagcccataaagacttttttgcttcaaatcaactactgcatagcctgaccaatcttcaaaaataaacatgtgcacgataacccactcaggtaacgtttctggctcaatgcctgggtaatcaatttcatccttggatagtcggatactctcaatcccgacttgatcaggtgtcactggttcgccaacattgtcgctaaacaactcacaaatccgacccagaatttcatcaaaagacaccattgctttgacacccttccttccgcttttgtacatcatcaccaattactatccgaatacaaaacattatcatcacctcacgaatacataaaaatagagatagcgttcggcaacaattgccattacactatctcctcaagataataatatatatttataaatccggttaaatcgactgcataaatctacagaaacagtatttacacccccatgcccccctaatccccctaaaacagcaaaaaaggcacgccctcaatggacgtacctcctatttataaagcgattgtatttaaagcaaccgcatcttctttttgatgttcgccaggaagcacccgtaaataataccgctgtgttatagccgggttactatgaccaagtaaccgagaaacatatgttacatcaagttcaggttgtgccaccaataatgatgctactgtatggcgcaacgtgtgcggactatggatggcctcgattcctaaatgccgttgtaatgtgtggaaggccgaattgatgctactagccttgggaagtcccttcccattgcttgcaaaaataaacccggtaccccgttttacattatcatgccataaacgtagcaggcgcaccacatcatcaaccaatgggatggtccgaacagcattgaccgtcttggtagcctttattttgcgagcagccgaatcataactcctctggattcttagctgatgtcgttcgggatcaacgtcctcccatttgagaccgatcacttcacccacccgagcaccagttgcactgataattgccaaaatcaggtaattagtgtccttaggtccgtaagaacgtttaaacaaatagcttcgtattttaagaaaatcatcacccgacaagtacttgttattgtcgttccgtgaccgttcctcattacctgtgaccacaacaccattcatcaaatttcgtcgaatcaatccatcgtactgagcattcgctaagcacgcttttacttgaatagcatgcttacggcaagtttccttcgaataacaataacctagctggttaaagatgctttgcaacaaggttctattaagttgagccatcttcatcttaggcactaatacctttaaatgctgataggtcaatttgtacgtcatcttagtagcggctgaaattactggggctttaaataatttgtaccacattttgaagtaatccacaaagtaacaattccgaattgcgcgcgtattgctactgccgttaacttgttcctgttctaataaccaggcctgaccagcacgtttactgatgacaatcttagtgtgccgggtgcgtgctggaccacttccagctgtatagcaagcccgatagcggccatctgaaactctttttatagttcccgccattaataatcaccccactcatcatttggggcatccgtataccaatgcttagccttatcatccaaatatccaaacaagtcacattgacgtaagcgtacttgttttgaactgccaattaagattcgaggtaaactcggatctaacagccacaaatcgaccgtctcacgagcaacaccaagcaatttggcggccgccggtatagatatcaatttattctgttttgttgtatccatgttgagggttcggcaaaggctaaggtaccggtcgacatagggtcggagcttctccagttccgtcaaggttttactattgttgcttttcatctagcatttctccctcacgtaaactataacctgccaagccgttaacgtgtccatgcatattaacaattggagctggctgtccccacaatgattgaaatgcttctctcagctttttagaaaaaatacttggattagttgtccccctatccgcaatgctttcgcgttttacccattgactgtactgttcgcgcagatacttcattgataaagttgcacttcggttttcaatcaagcatccttttataaaacgttcaactggccggctaaacaacatataatcatccttggcttcacgcattgcttttgaaattgtgaaattaaaattatttgtacgcaacttgctaagcccagtaagtgcccaatttaggattccaggaagttcggttgctagcttaacctccaggtcgacatccaccttctccaatggaatttggatttggaaaggtaaaatattcagtcttcgcgaaaagccatccgaagtatctgaggtcgttggcatattgttagttacgaagattaatttggttttcaacacggtagtatattgggcttggtttttcgcgttgatagtgaccgaatcaccgctacaaattgccttaatctccgcagtgtcaaaatccacagtttgtccctcgctggaaaggttagctcgcttgttgaccattggagccataccaaaatcaccagcaaacgattcgattttgctgcttgaaatgtttagcttaccgagtaatttctttaccaaattcaagtaaacggatttaccattacgtccatcccctttgattactaggaaaacattagctttaaatgaagaatccagcaaataacccgtatattgttgcagaaaatcctgatcctgttgatccgggaggacctcatttaaaaactgtctaaacatgggacacttagccttaggttcgaattgaacgtccgaatgcattcgggttagcttcagaggattggcctcgccgccattcttcaaagtatccatgtttataagacgggtaccaaacgccgcatattttttgtcaaagtcatcgccatcaatgggttttaatgatcgacttaatagtgccgttatatgtgcatctactccttgagtccagctatctggaacgactgcgttggtcacggcagttataattttacctaatacctgatcctgctgggataattcataagtgcaagtgtgccagttgtagatcagtaactcattgtcgttggccgtttgtcgcaaactgagaattttacccaaaaactgtgcaattccttctctgttcagccgtaccttatcctcgtcgtaaaccgtacccgtactttgccgtaataattcgataccaaacgtttcaacactttgagccaacgttacatttgatgtgtcctgaacttcctcatgttcctgctccatgtatcccacccaagaatgcttaatcaacgaacgcagaaacccgaaaggctgccagtatagcggctcttcgacctgatcagtggcgaaacgtgcaattttttgtttatcacccaacacttcaacattggtaaatttaaaatgcgggttaatatatgactttagataatctagctctggattgctaagggagcgtgaatctttgaccattacttagcacctccgtctttaaaaacatccttaaagggatcttcatttggatctgctggatgagcctgcatcgctgctaacaacgttttaggttcatcacctgaagcatctttttcctccgctgctgtcttcataggttgcttggcattaaagaagttcgcatcccagtgccaatcaaaagtgtggataaatttacgatcgttaacaacgtaatttttaatctttagctgacatggcattcctgtccaatcgtccgtgtccagttcaaacgtccctgtaacggcatgcattgattcagctaattctagatagcggtcatcgttaggacaaaagaagcggtccgaaatatgatgaccttcaatgttaaattttacgtctacggatgtcggaatcattacctcgtcctggtcataattggcaacaatatcctcaacagtacagttattgtaggccccttcctttaaaggcaacccgatagctaaattaatttttgtcatgttttattcctccaagcttttgtattttaaatatattggttaatggtaacgacaagtccaaaacacgcgccgcatcggcaattgcttgcataacaaccagttgcgttgcttgaatctgattgatttcgcatagaaaaataaattcatcgtgtattacatttacaatatgacatttattcccaagctcaatcattgtttgtttcatcaacaaggatgttgcagactgaacgggtaagttttgtcgtgttgacggcgatagccattcctgaccaatgcgtgctttcaaccgtgttggtttcattgcataataaatattagagctacacctaaatttacgtagaagtacttcaacctcaggatacaagtaatgtaaaacctccatcggtttacgttgaattcgcaatccacttttattaacaattgttagtagccggtttcctccggctccatacaacatggcataaatcaaagtttttgccaactttctcatcaccgatgtaaccgaagtaacatcaacttcaaataacttggcagcaaatagtttatgaacgtcaataccacgctcgaactggtctaataaccgttcacagtgggccgcgccagctagcaaccgtagctccatttgattcgcatcaaaactaacgtaaacgccggacttcccgtgtacgtttggggccacaaagtacttacgcattgcattcggaagagccgtcatcgccatctcgtgagccgtaaatcggcctgagtatgatgaatatgggtcccactccccagatagcctaactatcccatcgtcggtttgattatcggccaaagtatcccgaaaacgtcgcagtaaattatcgtagttgattttatttagcagtagttcaatcacacgatcatcatggcgatgttcgcttaaccagctcacacttactgatcgaatatgcagaccctttagttgagcatatgcaacgatttgagtactgtcttcgaccgaatactgaccaagtcctaaaacacctcgtagatctgccaaaacccgtgaacgggattgcacccatgggtcaacaccaacctttgaccaagcaataaagtttaagtttatggcttggtcacctaaggatcgtatcagcgaacacgcttgcagttgaacacgtacggcttgtcccatccccatcgcatcgaggtaatttacccagtctgaaggattcatattaggtaaatttcgattttctgggagaaaagccaatcttcttaattcccggtcagacacgaaagccccccgaactttaacgtcaccattagttgatttcatcatctatcaaatccggaatacaacctgggatatcgtaataaatattttccaaatcaggttcaacttcaaaatccgttttaaatcgagaatcgaacacaaaatcaattaaccggttgctagaatgagcatcattgccaatagtcaaatcatctttaactattgaaacatcggaaacccggccatgttcgtaattattggtactaatagtatcagtgtgagtaaccaaattaatttgtccaggtaaaacatcaatcattgcattattcattccttacaatctcctttgctaatataaactacgtttagggtaaatcaacatttttagtcttccaaatttggtggctttcgattatagcttggcattactagtcttcacacccttcagaggaaatctggctttttaaaaccaagtccacaaaataatactccatgtccacattttctactgaagatgtgatcaacaaagcatcttcgcccaccaactggtccaattcaacttcaccagaaccatctgacactgtccaaccaatttgtgaaaaaagtgaatcaaatactttaatcttattcactttagtgaacggaataactagctcatctttaaaatgtttaccactagagtatttaaggattagtttattatcgataagaacgacatcgttaatggagatgtactggtattggcgacagtatcccttatatggatcgaactgactgctgatacttacctgttgggaaactacttgcatctgattatttgttaacattaaaattcctccttggtttaacaccacattttgttgagttaccttcaacactcataatattaactggtacgaataatattttttatctctattttacttagaaaaaaatacaaaaaaatcgtcagcgtttagacgatgacgatttagccaattaattatttgcgattaattatttttttaattcctttgccattttttcgttggcttcatctaaaacaccaatttcttcaacaaaatggtaatatttatcaaaagtcgagtactggtgtctctttgactcataattgattcgtttttttataatattattacatgtattcacaaactttaaagatacctcaggatacaagctctgctcccaaattattttgacggagttaacatcaaaaccattcacttcttttactgccatgttgaccgaattaactgccaaagtttgcattttaatatggttaatatccttataattgtatttcataaatagtgttccttgccctaatccagaaacctcactctttttacaccaaccagcaagttcctcaattaactcatttcctactcggaaaacatcacccctaaacttttcttcgattgtcgattctttaacagacgcaaactttcctccattgttttgctgattatcgtaccagattaaatctgggaaagttttttctattccagcccccaaagtattatttccattacggactagattcgatatcttatcctcattataagtttgaaatcggttcacattcttttttaattctgagatgccacttgctcttttaaaactgcttaaagaaccgtataaccttaagttatccataacgccacaaatacttctttggagggaagaaccgtcgaacctgccttcttcacatcaagctgttctcccggataaatatttccccaagaacttctaaactcttttgaaacccataaatagtccaatgaattcttaattcttgtccttctggtgaccggttgactcagatttaaaaaactaatgttctccaactttgagtttactgccacgttcaccaatgtaaaacaatttaattctccatccaaaataaccactcatttcatcttgctcaattaattaataacttaaattatcagaaagtgtagcacaatcaagtcattgtgccacactttctgataattaaacttttattttgaaaccacatggtcttcatccagcatatactgaaacgcaacttcacccgtcaacaagttagctttaaacagcccttggttgccgttattttcatcgcccatgaccacgaagtacgtagcaccttcatcaacgacgtgttgaaaactaaggtaatttcccttgaacccttgcttccggaacaaaccaataatccgaatcatttcacgttgtgtaacttcgttcgctgctgttttttcactcattaattgtaactccaattctcttctttaatcttattttgccgttttagtaactggtttattaccagccaccacgtaactatcagttaatggcgtggcccaccaaccgttaaagcctaagcccatcgattgggtaatttgtaacccagcctcttgaaagacctgaccgtattcattgatattgcggccagtgtcaatgatcatcagatgaccaccaggtttcaaaacccgaatggcttccttgaccgcattgattcgagcctgttcatttttgatgttatgaatggcgaaacttgacgtcacgacgtcgaaactttcgtctgggaagtctaacttggtcatgtccccagttaccaagttaacccggtcggttaggcccaaatcatccacgtttttttgtgccacggccattttattatgtgattggtcccacgacaaccacaagtccaaaccggttactttgccattcgggcctaattgtctggcaatccgagttaataacgccccgcggccacagcctaaatctaggacctgactgtccggctttagatttaagtggtgcatagcctcgtcaaataaccggtacttcccctgagccgtagtgtgcaaaaagatcagggcacccagcaataatatgatgcccatcgtcatttcaatgccgatggggtacttcaaacgattcacgtacgcgtgccacagtaaccccacaccaaacacggtgtagatcaacagcgcaaacggcgcatcaaccccgtaccttttgatattcatccagctttgtccccttttaaatccccaatcttaatctccacggttcaccggggggattgggggctaggggggtatgatttgaacttacccgcttagctcctacttcttaaccactgtctcactaggtagtgaccaagttagcgaccactacccctaattcattaatttaacttatcatcaacactctagtcaagaatcccaaagccttcaagtgattcttcaccaagtttgattataatttaattcattaaaatattcgaattggtctatttaaatcgggccaattcatcatcaattaactgcatggcaatcccaaacgccttcaaacgccgcttagctagggtcaactgggacttataacaatcaggctgttccttagcttccaaagtcttaatagcttcctgaattttgtgcacgatggaatcaatctggcgtttggcttcaactaattcagcttcatcatacatcgtaaagtctccctttgaaagcaatcatgaaacccaaggcttagttttcatgattgcaagtagcgtccattttgccactaattaccaacctcatcagacgttatcggcacttagcgcccaaaaaagcactcccctgaaagcagcggagtgctctaaaaatcagtaaataactattaattatttgcctaacttttctttgcctaaaacgttcaatttttcgtcgaagtcataaacaactggttcaccagtagccatttctaagtccatgatgtcatcatcagagatgcgttcgatgtacttcgaaagggcccggagtgagttaccgtgggcagcgataataacgttcttgccatctaataatttaggcacaatttcgtcttccgtttaacgaaatttgattacatccaagctctacgttgtcaaaactatgttcgcattaaatctacaatctgcctcttaccaaataagaactgcagtggatacaaatgaaaattgacgttgcttaattttttcaacgttccatccattttcttgcagttgcgttgctaacttatgattactattcaacttagatttagttagtgcagaaatgagtttatccatcgaactaaaactattttttgttaattctttttccaacatagtccagttaccgaaataggtagcgtaatcttttatctcgttgtcacttgagatttgaattaaactatatttgtcatcactaaaaacttgctgataaagcgtatcattatcaaaatcgtcgtagattgcctcgtatagctctgctaaaagatatacaagcgtccatttcttagaaccacgcttcccaccttctttagacatcacctcaaagctagccttagtttgatcatcactaggcaatagatggtcatccatataatttataatagcattactatttgatagatttagcgaccaaatctgatgcgcaacatccgaaaatcctgattcaagcttgttggttccctgattcataatgatccgaaatctgacaaaaatagaaattatttttctaacaacggtcaacatatccgattcactgaatcttcgatattttaatgctaagactactggataataaaggagaatatgcatcctatttaggatatctaactgttggtctaaacgcttattttcaaaataattataatgagcttttggacttattggtgattctagtactgtatatatgtcaactaaactcgataaatcagttaaaaattttcgagcttcagtaactgttgatatcttatcactgatttcacgatacaatcttgcttccgaaacaacacggtagcgtgatgcccaataggttctaataaagcgcgtaatacggtcactattattatctaatggcctagtaatttgattccaaatttgattagcattccttaggtcatccttattcatcaaggacatcacatgattttttataatatctgatgcttttaaatcttttccacgactatttagagtctcaaaaatagtgaatgcatcttgtcgactcggtgcagaaatcattacaatgtaaaaatgttccataaaagaatcaaaaatgatctgcagctgatcaattcgtgtacccaactcttttccatgttctatgttggtattgatggatctggttatatcaacatatgcattaagcatgttttttttgggttctgaaatggttttataatcattttcagcaagacgagtattcgttaaccgcttaaagaaattgtctaatgtttcactactattttgatctccaacattttgttgaactaccagtgaaggctgttcgcctttagtacctcgaatagatttactaacttgccttcgaattatacgaagtgtatcgccaatttcatcttccatattaatatcacttggaaaactcttgatcttgtcaccaagtttaatagaaatatcccgaatagctgccataaagatcaaactggtggttaacctttgttgcccatcaataacttcttgctttccttgctcatttttaaaagtaacaacttgtccaaaaaagtgactattatgtttgccatcaatgatagcttgtaagtcattccagaaatcactcacttcatcttttccccatgcataattacgttgatagagcggtacgataaaattattatctcgaaataaattttctattttaaatacagacggactcggaatttcaacaaatgatgacatctatactttcctccaaatactattaatttataattggtaatttctataattaatctgaatagaaactaaaaaattcacaataatttcttacaattgtagcaattaatatttaatgaacgattactttaaacacttgtattgtatcatgtttccagcataggacactagcgcaatttatcagtaaaggtcacaatactttccaaccaatggctgctaccttagccgctgctcaaactccccctagccctgaattagctaaacaagactcagattgcaaaagacagggtgtggtcatcattcgattcttacggcaacattgacgactttaattgcctatcacttacgattaacctgttcaccagcagccatttcgaccacctttaacttaagaaccgctttaatttataattagcttaatcacttccattgaaacacaacccataactgttgatcatcggtcacgttggtgcttccccaaatcaggtaaaaactgatgataccttagcagcaccttaactaattaatcgacgaccgttaaaagtacatcatccacagatgaccattgaaaggttccgggctaattcggattaaatttgtaatcttgtccaaattaaatttacaatctaccaaataaccaattaattactcgatagattgtaaacttaatccgaactaacttatttcaacgcctatctagtggcgctgcaacagtgtataataaaattggtaagtatacgaactacggtgttcaaaatgatgcagaaatcatccacaaatatcgtgttgcgttttttagctgtggacctttctaaaaatggtgattaaactgattaaattggcaccatgaattagttaggcttgctattttatcaatctacattggagtagtgagggaaacgttatgaaatattgtccacattgtggcaattcggtgcgggagaaagctaatttttgtccaagttgcggtaatgctctggttgaaactagccatgcacaatcagtatcagatagtaacaatcaatttaaagaaatttacaataatgcaacggctaagttgaatcattatacaggtgaagagggcgccgttaaggttaacattgtagctttattctcagaagtcttcaaacaccacactaaagatgaggccaattctatttttattgcagggactaagacgactacacctgctttgtcggatgtttcagatgaatgggcaaagccatggttattttcgcgaattctgttaggatttttactcgcatttgtggtgttgctatatatggtagatggtttcagtaacagcaatgcgattcccggattgatcctggtgggagcctttgcagtcccattttcaggtctagtatttttctttgaatctaatgcttttaaagatattagtctttttgaagtggttaaggtgttctttattggcggaattttttcaatggtcgttacattgtttttataccaatttgtcacttttagctcgactagtcagatttttggggttttgacactcaaggattctttatcaattggaatagttgaagagcttgggaaagtcttaattatatcttattttatcagtcaattagatgtgcaccatgtgttagatggcattctgattggcgcggcagttggttctggctttgctgcatttgaaacggctggatacatttatagggcaaatgctcaactagttgcagtggcaatcttgcgtggctggtcggccattggtggtcatttggtatgggcagccatcactggcggagcaattatgattgtgaaacgtgaccatccgtttaagtttagtcagttgttagatacacgctttcttgtatttttcgtcttagcagtattgatgcacgctgcgtgggactggaacattaccatattgggcagtaattatctcaagttaattttattgattgggctagcttggatcgtggtatttgtgttgatgaatgcgggtctaaaggaaatttcgcatttgaaacaacaatcacattcttaaaatgaaataagttttgatggtagatcacaaattcaactcgaattttttgcccaattaatcaccctaacccgataagatgtttagtctcctatgatgtaattataattattagaaaattgttcaatataacgtattaaaagagccgattaactcaaaaaacaacgcccatcatctagccatttaactaagatgatgggcgttaatactaatactaatcattactaacagcgtgattctcatccaacatatattgaaagacaatatcaccacttaataaatcaattttaaacagaccttgattactattattttcatcactcatcactacaaaatatgatgctccttcgtctactacgtgctgaaaactaacgtaagtgcccttaaaaccttgtttgcgaaactggttaataatccgcaccatctcgcgttgcgttacttcattagttgcttcactcattttttacacctgatccttatgcattatttatctgaatactattcatgtctgatataaagttccagccattgatccaattaacaaaatgtcaattggcctctcttatgggagctaagggggaattgggggatcccttttaaattactcaaggcagtaaattattttctgctttttaatttctattttctagatagtgtccatttagcgtccatttgccactaaatgccaaccctatcccacgttatcagacctcagcgcccaaaaaagcactcccctgagacagcggagtgctccaaaaaactagtaaataactattaaattatttgcctaacttttccttaccaagaacctttaacttttcatcaaagtcatagacaactggttcaccagtagccatttcaaggtccatgatatcatcatcactgatttgttcgatgtacttgcttaaggcacgtaatgagttaccgtgggcagcaatgatcacattcttaccatctaacaacttaggtgcgatttggtcttcccagaaaggcataacgcgttccaaggtaaccttcaagttttcgccaccagggacgatgttagggtctaagtcagcgtaacgacgatcgttaacggctgaaccttcatcatcggcactcaataatggaggtaaaacatcataagaacgacgccagatatgaacttggtcgtcaccgtatttttcagcggtttccttcttgttcaatccttgtaatgcaccataatgacgttcgtttaaacgccaagtcttggtttctggaatccagagttggtcggattcttcaagcacatagtgcaaagtcttgatggcacgagtcaaaactgaagtaaaggcgtaatcgaattctaagcctgcttctttaactttttgaccagcagccttagcttcttcaacacccttttcgcttaaatcaacgtcaacccaaccagtaaattggttagataagttccattcactttgaccgtgacgaatcaatactaattttgccatagcagttaatgacctctttcttaagttatttactcaccctattttacactgaaaaagcgaaaaatcaaaacaatatcagcgcttattttcagaatccgggtggaaagtaatcgtttttttcagattaatgttaggtcgcggccggtgaaccggtttcacgccgatgatgtccaaaataaagttaaaaatcggtacaccgacgatcaatccccagacaccaaacagacgctcactcactagcaatacgacaaacgtataaaaaatgggcagctccgtgcgactcgacataaacttgggattcaagacataggcttctagggcgtgcacaaccaaaatcattaagagcatatagaccacgtagcgcaacccaccaaccgaataggcaatcaagctcagcggtacgactgaaatgatcaccccagcgactggaatcagacttaaaataaagatcattaatcccaagctaatcagttgaggcatcttcaagattgccatgaaggtcaccgtaatcaccgtattgacaatcgcaatcaaaaactgtgcttccaaaacaacgccaaagctattcacaaactttttggcaaagaaatggacgtcttgaaagaaccagccaaacgtactagtcaaaaagcgcttcgtgaagacccgcatctgatgatcctcaatcgtaaagaagaaacttaaaataaatgataagaagaaggttagtcccatattaccaatattagtaatatactggaacacaactgaaatgccgcccttcaattgtttgagtatatccgattcttgaaaatacgatgtcacccacgtcaacacttggttagtatcatgtgatgggttctgataaaaccgatagactgattcaaacgtcaaaaaagtttgtttgatcaactgcggtaaataaatcgatacagcaaagtaaattccaagaatgactagtgcgtagaccactaggacaatgatcgtcggtggaatcttcacccaccgccgaactgcccgaactaaccgcgtcactaagaacgtaaaaataaacgttaataaaataatactcatcatacttgatgccaagtatagcgttaacacaatcaacgccaatacgcaggcgcgccgccagcgcacatttcgtattaactgtgaccaaaattccacaaaatccacccctctactatcccttactcctattctaacggaaagtctcagcaataaaaattaaaaggccgttgtgaatcaacaaaaaacgtgtcaagtttatcactaatcgcacgataaacttcacacgttcgtttaaataaacacttaataacttatgagaactgcatctttaagctctctaatcctagtgcttggtgaataataactgaggcgccacccaacaaggccgccgattgtacgttcttggttgcaatgattggaacttgccggcttggcgaagttagcttggccgtgctctcccgaacattagtcaatagttgtggcaagatttctagaacggtcgtgttcaacacaaccacatccggcgcgaacgccgtggaaacattcgcaatcactttagatagatagtaaacaaagtcatcgaagacctttgtcacttccggatcatgattgatgtagtcatgcttgaccgtcgttaaatctaatcgttcaacatgcttgatggccttcaaccgagcccacaaggctttttcagaagcataatcgttaactgatgccaagtggtcctcaacgtgccgatcttctaacaaagcagtccccacttcacctgcttcgccttcatgaccagaatatagtcgcgaatcagccacgatgcccgcatgaatctgatcgcgaacgactaccgaaaccacgttatcgaaaatctcgttgtcatggaaatcacgttcaaaaacggccgttaagttagctttcttttccagaacaaccggaatccgtagcttatcacgtaaatactttgctagatcaaagtgtgttagtcccttgatcggtgtcttgaggattttattctcataaataatcccatccagcgcaatggcgacccccatcagaccatgaatcgtaccatagtcatcaacgttccgtaattgatcttcaatcaaatcaatgacatccgtcaacgtcatatcgctcgtcttaaagctttgaaagtgcaaaattttaccattcaaccgtgaatacataagtttgactgcgtcagctgtcatgtcaatgctggccacaaaaccatagttcacgttcagctcagccatcactggtttacgaccgccgtttttcgtgctgacaccacagccaatttccttgatgaactgggtccgcagtagctgattataaatatctgaaaccgtcactttattcaaactcaagttccgtgaaatctggctccggctaatcggtccttcgttaataacctgctgcagaacttgcttttcattcgtactgcgcattacatgtttattaataatcatactgaatttcgatgcccaccattgacaatcgaactactttacccaatcatgttaatttggtctgccattaattcaatcatcaacgggcaccttaaccccctaatctgttaatattctatagcatcaaacaaaaatagtacacaaaatagtcaattttatacccattttgacatatgaacgttaaaaaaaggtcaataccgatataaaatgaccgcccccgtagaaccaaaatatcaagaacgaaaactttccgtccttactcctacattctataacagtttttataaaaaaatcaccgattgacacctaaaagtaggtgttttatcgatgattgttaagtggacttccatactgttattaaattgtttatattactgcaacgacctcgctgcttgcgccagagacatatgttgtaaactggcttgttgtaaaatggcctcgatttgggcatccgtatactggctagcattaaatccagcttgcgctagctccgcacgcgttgcctgaatctgatcagagctataattcatcgtttgggcagcttgcgccagtgagaggtgttgcgccgctgctcgttgcagaatagcacgaatttgggcatcactataactactgccgtcgagcccttgcgcggtcaactcagcacgagtcgtctgcacttgactgtcaccataactgttgttagctgcagctgacgagcccatcgaatggttagctgaggaagttgatgatgaagcagccgcctgctgtttagtggttggcgtgcgttgcgtttgttgctgacttccggtcatccccgtaaccgcttgtgccgcactcgggatcaccggcgctgaaccggtcaatgtcttgagtgacgcattattttgtttctgtaaatccaacacatttttccgaatatcctgatagtaacgttgcttaaacgccttatcctgcaataacttagcaattacaacgttagaatccgtaaactcattcgctttattcagctcagcagctttctgatactgttgttgataagtcttgcgtttttgttgcactttttttattaaggcaagttgttcttgggcctgattaattaacgtaactgcaccgtgcttggtcgtcttaaccgtcataaagtcacgtttagccatgtcaaatttccgcgcagccaatgcttcttgaccagccacataagtctgggtctgggttaaataccgttgcgcctcagtattactagctttcgttctggtcgcatgtgtaaaactcgtctccgctaacgtataattccgcgcttgcagtgcccgctcaccagttcgcatttcagccgtgtatgagtcttcctgcagacggtaccgcgtatatgaataactaccaacccccacagcgataattactgcaaacacgatccacatccatcttttcatcacgacacccccatcaactgattttgtaattaatttattataacatgtttacgaatcaggtcgcgattcgttgtgcttacaaaactgttttcataagcgtataataattagtgtattttacgaagaaaggatccttattgcaatgctagaaaaaaccttttaccacacccttctaagccactcattcaatatgcccgtcacagtcaactactgggatggaagtagtgaaacttatggtgaaggcacaccagaagtcacggtgacttttaaagaagccattccaatgcgtgaaatcaccaagaacgcttcaattgcccttggtgaagcttatatggatggcaaaattgaaattgatggcagtattcaaaaattaattgaatcggcctacgaatcggcagaaagtttcttcaacaattctaagttcaagaagttcatgcctaaacaatctcactctgaaaagaagagtcaacaagacatccaaagccattacgatgtgggtaacgacttctacaagatgtggcttgatccaaccatgacctattcttgtgcttacttcaaacatgacactgatacattagaagaagcccagattcataaggttcatcacatcattcaaaagctcaacccacaacctggcaagaccttactagacattggttgcggttggggtacgttgatgttgactgccgctaaagaatacggcttaaaagtcgtcggggtcacgttatcacaagaacaatataacctagttgctcaacgcatcaaggatgaaggcctcagtgatgttgctgaagtccggttacaagattaccgtgaacttggcgacgaaactttcgactacattaccagtgttgggatgttcgaacacgtcggtaaggacaacttagcaatgtactttgaacgcgttaaccactatcttaaagctgacggcgttgccttattgcacggcatcacccggcaacaaggtggcgccactaacggttggttagataagtacattttcccaggtggctacgttcctgggatgaccgaaaacttacaacacattgttgacgccggcttacaagtcgctgacgttgaaaccctccgtcgccattaccaacggacgactgaaatctgggataaaaactttaacgctaagcgcgctgccatcgaagaaaagatgggcgtgcgcttcactcgcatgtgggatctctacctacaagcctgtgccgcttccttccagtctggtaacattgacgtcatgcagtacctcgtaactaaaggtgcttcatcacgaaccttaccaatgacccggaaatacatgtatgcggataaccgaatcaataaagcttaattaaatgccaaaataccaactatctcgattatttcgaaatagttggtatttttttgaccatttttcaggaatgactgacaactagctttcagtcaccgccatgcgtacccaacccaagatctgatggtagatgagtaacgatcctaggaagaaagcggccgctaaaccggcggatgtcggtagtttgttaaacatattggctggtaacactaaggctaatagtggaaaggcatacgctgctggcaattgtaagttaagcgcccgtaaccacaaatacacaagtggtaaggcaatgaccgtcgttaatagccacgaagcaatcaataggtgaatgccgaccccaatactagcagcagccgacaatgcaagccactgcttaagtgcggtcgttaccgtatattcagactgttgagccgcttcaaagaaaacgacgatcacgggtgggattgcggccatctgggactgtcccgctagccaaacaatacccacccagacaaaaactaggctgataaagccgagcatttgccagcgactagcagaagcttcggttacccgtgagattgatcgcggtcgttgaatccaagccccaatcatcaggcaaatagtccagaaaaagatggctacgataaaggtccagtgcgttgcattaatgataattggcagtaagccagtagcaaaggctggcgccaaattcgattttaaccccttcaataataatagcatcagtaatagaccgacaagcactttgagggcgtacgaccaaggtagttgattgactaagaagccaataattgcagttccagatggtactaagaataactttaagggttgccgagtccacgccgtcttacgataaacccacgtcccggctgtcagagcaccgatttcgggtaaaatgatttccgcatcatgttgcaatgtggcactcgccaccattaatagaatgaagctccacccagctaagtatcgccaaccatcgctttgctttaaatccatttcgacaaaatattcctttcttatatttaattagatatatttatattatcaaacgtcaacgactagcattgtaccataaatacaatcgtctcctcaaataatcctgaaaacacatcaacagttttcaggattattttcaaccactttcctgacctctaaatcaaaattcgactgagtaaagtcttacccagtcgaattcagtcgtcgcgccaacgcagtcagaaaattatgcattttgcataagccttttgataactaaacggttatgctatttatcgtactagtaattggttaaccagcctacgtacactagccgttacggcctaacatcaaaaatatgaagatggcttctgctactcgtaaccaccaccgatatcggtgccaacgtaataccgaccaatggtgttttaaccactgattggcatagtgcgcaatcagtggcgccccgataatcataaaaccctcggtccaaaaatcgacgcgggcgggccaagtcgtgttatcaaagccagcaccaatggtcgcaactacgagcaagatgtagaggccccacaaactgatttgtaaaggtcgtttgactttcggccaccattgccgggcctgtattcgcttaatcattgattgacggtgcggccgataatgctcatgaccaggtaacgctgctaacattgcagtcgcactttgatatcgttgctgtgggtctagggccgtggccttcataataatcggggcccatgttgaatcctgtgtcagtgtcgttgtatctaacggcccgctcggctcttgaccagtcaacaaacagtttagaacgacccctaacgaatatagatcgctccgttgatccgtttgggcgaagccatagtttttcaggtgcggcaaaaccgatcgtgcctaataaacgagtatcactgtcttgctcagcatgatattgtcgcgctgcgttgacgtcaatcaaatagtagtgatcccgataacacatcacgttacttagtttaaggtcccgatgcacaatttgttgttgccccaacgcctgtagcgttatcaacaattcttgtgcgacgcgcaccgtcatttcgggggaaaacggtccttgtgttgccaatcgatccgctagtgtttgaccattaattaaggtctcaacacttacaatgcaatcagccgccgttaataatgcttcgatccggggcattcggggaattggctgctgcttcaaacgctgtagaacaggaatattatcaggatttactagtttagctaccgaaacaacctgttgcttcttaaccagtaacggaaactcgcgttgcgcaactaatggtcctagtggttcataaccagccgtacttaacaattgcattgcttgaacaatcggtaacaccgtgacacccccctttttatcaaaattactaacttttatcataaccatacttttggaggaattacaatgtcaaaatatcagaataacgaagtcacaccagtcgcaccccattcgcgaacagccgaattagttttaggaattattggcggtatcttcggtatcattgccggcttactggcgatgaccatcggcggcatcggtagtgctttagaaaccagcggatcggctggggtcagcaatcttggcgttggctgcattattgtctctgtcctcgcgattattttaagtgtcatgattaaccgcaatcacgttttaatgggctggttgatcatcctttgtgggattcttaacttcgtctttgtcagcttcttcgggattctaagaacgtgtttggatactttgacattcgatttgattttagttaaattagatcaaaaacaggagtttttaatccatgaaaagctttgcacaccattatag

SEQ ID NO: 21 - DNA, 20327 bp, synthetic construct
  source 1..20327: mol_type = other DNA; note = Lactobacillus plantarum PDG8 - contig 21
gttttctgtggttactaaatatcataagggaaggcattccctatttctatacaattcagaaatcttttatgcatttacacaagatattttacgctctcagaacaagttgttaggaaaattgctacaggtgagaactatcgtattaattacataggaacagtaatttatgaagatgaataactaaaataacatacatcgcactgttttagttagggtctccggtagctagtggtgatgaagtaatgttaagaatctagcttatttgagaattgatattttcctgaattttaaacttgagttcaatctcgaattgtcaaatcaagtgtaacaccctcgagtcattcttaaatagtgggctgattaatatctgtagagccatccattgatggctgatgggcaagtgtttgccgtggccagtatttcaaagcatctttgatagtttgaattctagtgatagttaaggcttgtatgcacggactttccttatagaataaactccctgatttactatgacttatttatttggaggagcgtctggctaatgggtaaaatgaattagtcagtagaaataactggtatccgatgagaaataattgccgggtaccggttattttttaagaaaatattgaaggagtttcaagctaacccaaataattttggatttgagacaccttcagctaatagaaatcataaatatgaacaataaaaaggagaagaaaaaacaatgaaaatattaaatgtttttgatgcagtaagggatggcacgtttcaagactttaaaaatttttatgaaggaaatattaatgtgattagtggaaacttggatttgaatttattatgtatggcagttactaatgataaaaatccagaagaaaaacttcaaataataaagttcttatttgctgaaggaatagatgtgaattatgctacacaaaaagaaaaacgaaatgcacttcatttattttatttttgtgttttgcgacctactatagaatatgaaatggaaataacaaatcttttcattaaacatggagtgaatgtaaatgcgacagacaaatacaatgcaattccattgaaatatgctattacaataaataatttgccaacttcggacaataaagaaatgtatcagttgctgctgaataaaggatcagattacaatttgaaagatggatttggcaaatcatgtttagactatgcgaaagaatattcttggagaaatgattttttagatattgtaaaagagtatgaaaatagcaaaaaatgattggagattgaaaaatggcaacgattataatcattggagtagtaatcataggaattacgctgggcttaggattctggagttatttactgggaaaaaggaatcaatctaattttgttggcactatcattccaatagcttactttgtcgttcggacagttttagctgtgacgacacaaaatatgacacgtgggctagtatcgtcattagtcggtagcttgttattcagtctggtttactatggtttatttgcttgggggaagcaccggactaataagtaatatggattagtcagataaaaataaaataaccgatattcgataaggattaattgccgagtatcggttattttatagaaaagtttagacaagttgagttatgagggtaggaacgacatatgttggtatttattgtgattggattgattacgggggtaatcacgattggcttgggctattggagttatgcattagggaaacgcaataagttgaatttagttggtagtgtcataccagttggtaatttggtgattaccgttgtttatgccctactgtttgttgggggacgacaacgattcaataagcaaaagcaaacaaaataggtcggctgaagatccagaatgttgatgaaattacgcgtgctggactttttagactattgcaggtattaataaaggcattatttcgtttttgacgaatctagttaggtataatgatatttataccatgattacggggaaagttgccgttaccggtaagaagtgtttatgcttagcaggtgtggcttggacatccctgaactctgtgcctgtctcaggaaagcaaagaagtgaggtagaatatatggatgttgatgagaattggtggcatgagagcgtactaaaagagttccataaaggtggtaagcctaatccagattttaatcctaaagcttctaagaatacccatatccctgtcggtaaatagagaaagagtagagaaatatgaatatagaagaaatcaattcagaaatattaaaggttaacaattatttaaaaaaatgtttatggatggattttgaatttgctagtgtggatggtggagatattgttgcagcaggtagaatagatacttcatatgatgagttttctattaacattgatttcaggaaaccttattatctgtctagtttgctgtattggaacttaaataattctaagccatttatagagttggtagcaggcaaagaaatgtggaaagtcatcgataaataccaagtagaagaaggaaattatatatttaagattaatgctgaagattttgacacagcaccaataattattgctagtaaaggtcttaaagctgaaataataaataaagatccattttaaaaacaagaatccctgagttattaaatcaagtacaatactttcaactcgttcttaatcaggattttagctgattagcccattccagatggctttggataacttgaagaccagtgatggttcaggagcgcatcgattggtccttgggtatgagtttctggttcaactgtggcttttgttagtccagtgttccacgattagtatggtataccattgtgctaatcacttatgacaagtctgaaaattcttagctattatcaaaatttgcagcttttaaatgttctggaccatatccatgatttgctggataagacagtgatgggtatggcaatggaaagggtgatgttggacctcgtaaaggtattcaaaaatagtaaaaaatgacaatgattatcattatttgagcagtcatcataggaattacgctgggattaggattatggagttattggttgagaaaaaggacccaaactaatttagtagatgtcattattccagtagcttattttgccgttcgagcaatcttagctgtgatgacacaaactgcgacacatgggctagtatcgtcattagtcggtagcttgttattcagtttgatttactatggcttatttgtttgggggaagcaccgggccgataagtaatatgaattagtcagattaaaataaccgatattcgacaagggctaattgccgagtatcggttatttcatagaaaagttgagttatgagggaggcaacaacacatgttggtattttatcgtccggttagtctttgtgcgggtacttggtgacggcatttgagaactgataactagtttagttggtaatttggtgattaccgttatctatgtcctgttgtttgtttggagacgacaacgattcaataagcaaacaaaataagtcggttgaagatccagaatgttgatgaaattacgcgttctggactttttagacgattactggtatgaaaataagggcatcatttctaacggatctagttgggtattaatgatgtttatatgaggtcaagaaaatgagtggagataaaactccaaaaagtattgaagaagagttgacgcctgctcaaaagaaaagtgtaaataataatgttgctgatcatttaacggatggagattttagtggaactagaagagactcagaagaaaatcctgttccaaaaacagacgcacccggggaatactggaactacttagatgaaatgctaaatacgtacaaatctataaagaactcaaaaagaagaatttatgaaaatatataataaattcaaggaaaaagcatctgatctatagtttgttataacagagttattatctaaaatgtcaaattaactgattccgattctcgttagtgccatattctcttggtgagtaagagatgtgcaaaatagaccgttgcgcaggtcacttgggataagtccgcaagtttggacaggttgaaggaaaaaattaaatgtggatgatgattgtggtattgaaaaatgttggaacaaagtgactgaacttttgtctcttaatgaggatattacaataaagtatttagaagattgtgatgcggacggacttatattggatcagtgaagtttttgaggatatttctgccaatttgaaaagtcaaaagtttattgattgtttaaggaaattggataaaaagtttccaggattagaaatggcacatgacattgatattgctgaaagttatttttaaaggggtatgtaaacagcataggcggactataacattaatggaaaagtatatcgagtcgcatatggggacaacggtttcgtcgtatcgtttcatccaatgtgagaataagtaatacgagaggagaaaatatgagtaatttagaaatatcaaaaaattgggaagataataatttattagaactaagtattaatgcgaaatcaaaatttgtaacaatccatcaactgtgctatgtacaagatacagatttaaaagaaattggcgagaaaattattgcatattctttcgacgctaaagaagaaatttatgtggaatttggtgaaaaagaaggaaattttacaccagcattttctttaagctttttaccggccgataattctgggcgtgtaaaaatagagattgatatggagattgacgataatcctgatagaaagcatagatgtaaattttatatttatagtgagttaggattgattgagcaatttggtagaagccttattctgctatctgaaaataaaaatgaagatatcgcattgaatgttagaaattaaaggcgatttttataatcaaattagccactaatttttctactccgggttctcaaaacaagtgtaacacgtacgttaaatagtggatcagttaataaaataaccatctatgatacctgataagtaagtgtctaccatgcgtattggttcaaaacatcttgaatggattggatttcagtaataattaagaatcgcataaattatcttttggaaataaaatcgcgaatttaccggtttggatttacgcctaatccgtgtttccaaggtgagtatgggtaggggaaataggcctcgatggtttttgggggggtagtcttttatgtattacactttaattttagattcggaaagttaagtgaggtaataatggaaaataaaatttcatttgtcgataaagttgagcttgtgtcgttgaaagaacgattgaatgatttaaattattttgttgttacagtaccaggcaaaaaagttcgcacgtttcgtcaatatctgaattttatgggtaaaaaatttaaaatgccagattatgcaggctttgctgcctattcagattggatgacagacttgagctggatacccaatcaaaaaattgcagtaataataaataaatatgattttttcatgaataaaaatcctaaattaaaaaggttcataatggacagctttgaggatgatattttacccttttgggaaaaggatgtcgttcaatttatggttggtggtaagccaaggatttttgaagtttatattgtaaaataatactttatttgagctacagctcagatagtgatcttaattacgggtagtcaggttgagcagacgttcgtatcataaaacaatcagtaatgatgggttactcgaatataatataaatagttaggtggtgtaatggctgttctaaacttaaggctatgttgttgaggatagcagttatcaaatgaatacccaactgtggcgttgccaacgatcaacgttgctaaggtgttggcaaaaaatgaacgagaattaattattttgacgcatattaaaaatcagtccgtcgtattctgccgtgataaaggcagcgaatgcgatggactgattttttgaaaccactaatttaacaagctaggatcaatctggcggtctttaaagtagtactgacggtcgtgatcattaatgtgtcgcaagatatgggcgggattccccacggcgacgacgttatcgggtaagtctttggtcacgatgctaccagcgccaacgacgacattgtcgccaatcgtaataccgggtagtacgatggcacctgcgccgaaccaacagttacggccgatatgaactggcatattgtactgataagcttgttcgcgcaatgatggcaaaatcggatggcccgcggttgcaattgtcacgttggggccgaacatcgtatagtcgccaacgtaaatatgggtatcatctaccagtgttaggttaaaattggcgtaaacccccttgccaaagtggacatggtgtccaccaaagttactgtgaaacggtggttcgatgtaacacttcgggccgatttctgcgaacatcttgctaagtagaatttggcgcttggttagttcgctgggccgagtttggttgaaatcatagagctgatcgagatagccaaattggcgtttttcaagttcagggtcgttaggtaagtagagttcgccagtatgaagacgatcgttattattggtcattaattaaacttcctttcgtggatgatggctgccggtaatcaaggctaagccacctaaaatgagcataatccaaatgagaacgttggcggtgagcgtctgtggcccaagttggccgagactgttccagaccagtggcgcaaagaaagcgctgataatggtggcaatcgtcaggtagctactcaggacgttgacttgaatggtatccaggccagtattgctagtgaagaccaaatatggcccggtgtacgagtaaataaagttgaaaaatacggcagcgccaatagccacagttgcattggatgccaaccataatactaagactgaaatagctgctccggcatagcctaaggttaaggtgaaccggtgtaaatagcggtatagatagccaaaggtgagaccagccagcaagccaccgatgttcatggctgctaaggttaagttgatagtggcagcgttaccaaaatgacgggcgctaaagtaactcggcagctttaattgaacgccccagatgagtagataggtgataaaggtgagtcctagtaacgtccactggtgccgtggtagttgtgtcttttcagtgcgtgcgtgattagtcgttgttgatggaacagtgggttccggtaccaaccacgccacgcccccagcaacaatcaccagtagcccgtatagccaaaagacggcatgccaactgagactgatcagcaggcctgctaatcctagcaatatcgcgttacctagggctgagaggcccgtctggtaacctaacagtcgggcccgtaaatcaccggtaaagctgtgggtcaacaaactgatggcatgtggtgaaaagaggccgacgcctaatcctaatccgagccgactgaccatgattacggtaaagttagtcgtgatagcgggaatcagtcccatgatggcgctgatcaagagtccactaatcacgattggccgtaatccccaccggcttgttaatcgggggttgagtaacaaagtaatcaatgcgctacagttggcgatggtgacgagccattcaatcagcgtagtcgggacggtgggaaaggcccgcttgagctggggaatgattcctgtaataacggtagtgatgcctgttacagtggagaggctaagaatactgatggtggtggtcaaccgtggctgcatggcttacgcctccaaccagtttttgatccactgtaagacgccttgttcttggtttgtgcctgtcgtggcgttggctacggctgtcacggctggttgagcattcgccatggcaacgccgcagccgacttcccggagcatttctaggtcattgcccccatcgccaaatgcagccatgtctgcgaggtcgattccgagaacctggccgagttgcgctaagccagccgccttattcatgccgggttggataatgtcgatgtcgccgtgaccactgctggttggttcggcgacacccgttagtaactcgcgtagttgcgtcacgatcgctgtggtgcgttctggtggacatgtgatggcgaacttcataatgtcatcatcaagctggtcgtaactttcaacgacggctaagtgatgataataatgtcgcatttgtgccacgtgctcaggattagtggtcgttagggtgtaggcacttttggcaccgcaaaccagtagctttaaatccgggatggtttgaatcttattcagaatcgtctggattgtgtctggctgaaaggcgttaagtgcgtaaacgtggtcggcatcgcggatataagccccattttcagcaaggtagatcatctcaggatagtccttgaagaaggacttgagttggaaatattgattgccgcttgcaatcacgaaccgtacgccccgtagttgtaattgttgataaagcagtgcaaattgagcttcatcgtaagtcatatcgtcacgcaaaaagctgccatccatatcagttgccattaatttaatcatggttaaaatctcccgtcgtttaattgatagccgtagcttaccacgaaattcagaccacgaagggacatttttagaggcaactagtatcaattcggtgatagcgggcataggcttggcgatagtcggtaggcgtcatacccttccaagatttaaaattccgattgaacgtcttactattcggaaagccgcattgcatggcaatatattcaatcttatggtcggtctctaacaggaggcgacgggcgttcatcaatcggatcagtcgtaagtatcggttaacggatagttggacgtttgcattgaattgctgattcaaagtggtcaacgaaacgtgaaattgctcggcaagggtattaccatcgatgggctcagcgtaatgttgattgatggcagtcatgaccgtatccgttaatgtcaagttagggctgaccgttgttgcagtcagaggaacggtaaacgtttgccccagagtgacaagtaactggtaaaagtagctgaggatttgtaatctcagtagatcggtcgtgggggtcgtcaacaggtcgtgaatcgtgactaattgttggcggacatcggcgtaggcttgcgggtgagttttcgatgaggccgcgccgttcaatgtcaattgccagttcgcacttgccggaatttgagtttgtaagaaatcgtcgtcaatgatgaggccgaactctacccagtcaacttcggtgggcccactagcgctgtgaaccatgcgtcgattagtagtccaaaggtcaccaggccgatattcattcgtctgtccatcggtgacgaattttaaggtcgtaccgctgacgagataatttaactcaatcccttggtgccagtgtggggcaacgttgatatcagtcaatggatcatgttcgtaatatttaaaggggaggcggggaattgtctggaccgtctcgtgtaagattttcatcactaaacctcgcttcaagattttgtaaaatcgcaccgcttcctttcaaaaatcaaccttgatggctgacgcgctatgctatattagaattatagttcgcgatgagcggtggcatgacttaattgtaaccgtattcgcagttgaaaggaacgaaaacccatgacaattaaattaattgcgattgatattgatgacacgcttctggattcaaaggggcaattattaccaagtacgattgcggcagttaaggaagcccacgaccaagggattaaggtggtcttgtgtaccggccggccacttgctggggcgcaacattatttagatgcgttaggccttgctggtgatgaccagtacgtgattacgtataacggtgctgtaatcgagagcattgctggccggatcgtcgccaaacatttagtggataatacgcactatcggcaattaaccgcgtttggaaaacaacatcacgtgccctttaacgtgctcgatgcggacagtacgatctatacagctgaccgcgatgttaactgggtcacagttgtacaggcgtgggaaaacaaagctgggctgttgattcgagaccctgacgatttaccagctgattttcaaattgctaagggggtctttgtaggtgaaggcccgcaactcgatgccgtagaagcgcaagttaagacgacttttggtcgggacctgtacgtggtacgtgcggcaactaacttcttggaactgatgcatactggtgtcaacaaggggcaggcagttcaggatttagcggcagctctggaaatacaaccggacgaagtgatggcactgggagacgaacagaatgatctgccaatgtttgctttcgccggaacagctgtcgcgatgggcaatggcagtgatattgctaaggcacacgctgatcacgtgacggctactaatgatgcgaacggggtcgcagctgcgattcggcagtgggcattatcggattaactcggatgattatttttagcgaaacagttgacaagactacgcaatgagtttatgattgcaaatattaaaaataaatgagactaaacgtgatgatcaggagagtaaagtcagggtaatcttaagcgagccgctggatggtgtgaagcggtggtgagcctggctggaaagtagcctgagaactgctaatgcgacgagctggagtgttagctgggtgcccccattaacgggccaacgtatcgtcagttaacattactgtttggggaaacccgtcatcagtgttggcaattggccgtacgcgcaaaggtgacgagctgcggttcgtgacgaattaaggtggtaccacgcgttagcgtccttacaaaatcattaattgattttgtaaggacgcttttttagtctcatggcagttttgagaggatggggacaatgcgcttaacaagtagtgatggtggtttgtatcgagtgctcctactagtgattgttcaaactggttgatgagaacgacgcttaacggaggagagacgacgatgcaaataacgcgaaaattaacaatcaaacattacatcattattggatcaatgctctttgggatgttttttggggctggcaacttgattttcccaattcacttagggcagctagcgggggccaattggttgacagctggttggggattcttgctgacagggacactattgccactgttaggaattatcgccatcagtgtgacgcacagtagtgggatttatgagctagcgcggccaattggcaaacgctacgcgacgatttttatggtactgacttgtgcgactttgggccccttgttcgcgacgccgcggacagccactacgccgtttcaaattggtattgctagtcatgtgagttcggcacaggcaccgtggtatttattagcttactcattgattttcttcagtatcacttactgggcagctcgtaggcccacccggatcgtcgatacgatcggtaaattgttaaacccagcttttctgattttgctcgccttaatttttgggattgccttcagccggccgttagggaccacgaatgcgacaccgaccgcggcctaccaacacggcgcgttcttgaacggttttttgcaagggtataatacgatggatgcgttagccgccttgttgttcggaattgcagttgtcaccacgattcggggccttggtcaacgggatgccggagcgattgctaagacggccgccaagtctagtttgttgagtattagtttagaagcagtcatttatcttggtctgatctggattggcgcgacgtcgttatcgcaatttaagttgtctgcggatggtggcattgcctttggtcagattgccaatgcttttatgggcacgccgggtgcgattgttttagcaattatggcgaccttgacgtgtctgacaacggcagtgggtttggcgacgtcatttgcggaagccttgcacgctaaatttcctaaaatcagttatcgcgcttggaaccgcttggcctgtggggcctcatttctcatcgctaatattgggttggatcaaattattgcatggtcgacgccgatgctgatgttcctgtatccgttggcgattacactgattatcttagcgattgcctcaccgctatttcattgtgatccgctcgtttatcgatggacgacggcgttaactttgattccagcgttcattgatggtctaggtgctgcaccagccctgattactcggttaggatgggttcaaacgattcttgcatgggatcaacgctacttaccattagctaaactaggatttgattgggcacttcccgccattattggtctactgatcggcttgggctggcactatgcgcgccggttccagaacgcccatgcttacaagatgagccaggactaaaggtgtatgatagatggtaagacttttgatggatgggtgagcacatggattttttgggaatattttgtttgttgattttggcgacaaccctcgctgggcactttgctcaccgtgcggggattcctgccgtaattggtgagattctggtcggggtgatattagggccggcgctatttaactgggtccatttaacgactttagttcaaacgttctcagatattggggtcgtggtactgatgttcatcggtggactggaaagcaacttagcacttttacgtaagtatttacgccctgccattatcgtggctattattggagtgatttttccagtcgttattatggggcttgcgagtcgcttctttcagtttagctggtttgaatcactgtttatcggtgtcatcttttcagccacgtcggtttcgatttccgtggaggtactaaaggaatttaaagtgttggatactaaggaaggagccacgattctaggggccgcggtcgctgacgacattatcggggtgattctattgagtatcatgattgcgatgatgggtggtcagagtggtgttgcccagactaatctcggtatcgtgctcttggaacaggttggcttcttcataggggtcttcatcgtgattaagtgggttgccccgtatctgatgcgcttgagtgatcatctgttgatggctgccagtccaactattatggcgattattatttgtttagcgttggcatggttggcagaactagtgggcttgagtggtgctataggtgctttcttcgccggagtcgcaattgcacaaactgattaccaacacgtggtggacgttagtattgaaccagtgggctacacgacgtttattccattattcttcgtcagtgtgggtttaaatatgacgttcaaaggggtctggcaatcgctaccgttcatcgtggtcatgacggtgctcggtgtgttaactaagttgtgggggtgtggactgggcgcgaagttaaatgggttcagtcgccatagtaattacttagtcggtgccggtatgatctcgcgtggtgaaatggcattgataacggcgcaaattggattttcagcgcacttactatcaaacgattactattcggatattattttggtcatcattgtggtgacgatgattgcaccattcgtcttaaagaatgccattcatcgcgccggtcaggtgaccgcaacacatagcatcatagaagaacattaaccacatagattgggcggaagttaaggaccgcttggacgacgtagtatgggactacggcgtttttttgagtctggaagatttgaacgaggagtgagggtgttgcattagcatgttgacttattgtcgtggtggttgtcgactaaacggctattttcgtggtatcggtgaattattgtatgataatagctaaaaatatgacgtttgtaaaaatatcgttcgataggtcgggtgggtgttatattaagagcatagaaagcaattaatattgaattgataagcaacaaaagtaaactgattttatcgttaaatatttttaaagaatccggatttttaaatcaaattgatgaaatataaatataggaaaaggtgattaaaatgaaaaatattaataattttcaggcattgcaaaaaaatgagctttctaaagttaacggtgggatttggcaatggattgtgggcggtttaggctttcttgctggtgatgcatggtcccattcagatcaaatctcaagtggaattaaaaaacgcaagaaaaaaggttatggctactagcctttttatggttaaatacagttgttaaggtgggtgattaacctgaagaaaaatacattattcaaaggctgtgcgcttttaatttctcttttgtttgttcttttaatgtttcaggtagataaagacatgatatggctagcatatgcctttgcattgctagctatacctaggcccaggcccaaatatcctaaaagctatgacaaatggtactatatagcatttttatttttctgtcttgcatatttattagaagaaaacattttgggaaatttgggaattatagtagctgtaatttcttttagtccaactactcatccattcgctaaaaataacatcgataaaaaataacatgaacctaagtgcagcactaatgagagtttatcttcaattctttagtactgcacttcatttgacaattctagggcattattcctcgttggtgtaggtttaaatataatgttcaatgagggctggcaatcgttgccatgaggtgtgttaactaagttgtggggttgtagactggattcgaagctaaacgagttcaatcgtcatagtaattatttggtcggtgtcggtatgatctcgtgtgaggacgatgattgcgctgagagcgctatttgtcgcgctaatcggtattacgagagtgcgctacttcattattattactatgaaaaacggctccaccgtggtaactgccacagtggagccgtttaagcaaaaactgaaaaatcatattatctcatttgtcagtttgacagaaaggcatacaaattcactcgtatttataatgtgctatcgcccagcagccccatcactaatcacatagattgcaaaaactacaataagcactaccagcaagcttctcactgggtatttcttaatgatgtttattgttttattgagcattaacgtgtgccttaccttttatatttaaattaatgtgccaataattaaaacggcgtctgagatccaatggacatagatgccgctccgtaaagtattggcagatcgccatgaagcagttattggataacgcgtaataccgacgattaagggataaatccagttgaaatgataatgtggaaggtgcaaacatgcaaatacgatgcatcccaatatattgataatcggccacgcaaattttttgagcttggtttgtgataataatcgaatcaacggaattgaaatagaggccattccgacttcctcaccaactagtgatactagcagcgtgaaggctatccatactctttcaattaaaggataatctcgtccagttaaactagttgtcaatgttgtattgtgaaatgacaataaagcatgcgaattaataatagctataaccacaatcgcaatgacttccagaataaacaataaaagcacatacttcaccactatacgccactttggcgagggtaacggttgaaaaaatagttttaagttagaaaaaccatatagcattactaaactaattattccagctgtaagcattgctaaccaatcaaaataaatattaagaaaaatcgcacccatataaccagccacaaagagcactaatactagcgggtaatattttcttttgaaatcaatttctatcatctatcataatcccccgagacatcaattacagcgcgtgcaaccgattcaaacacgtgctcaacgtcatttttacggcttcggcggccaccagaaatgttattttcaggatcagcagttaatttcgccaaatttatttgaaacagttaatttaattttcataatatgcgttccttaatttaagtacatttattaagatacactacaattctaaaaaaatcatttttaaatttattaatatactattcacccgacttaacgtaattttgaaagtgagggccattaggaaaattattttaacaatgatttgaaacgattaaatagtattaagtattcataatggtgtttggattgtgcccttcatggttgtaatacttgcttatctgtatgtatgtgttttactcacttttaataatagtgtttaattgatggatgtgctttagatatattacaatataaacgaattttaacgttaaaatttcataatttgacgttaatacctaattttgcaaaactatttataactatgttaaatttacagataaggagggggtattattatgactaaaaatagtatgtcttttgataaagtagtaggtaaaagtttaaatgttgagcagctgcaaaaggtaagtggtggacagtttaagaatatttcattaatgtatggaaataatgtttcccgcaaaacactgacaaacttttttaaatctttaataaaaaagataaattaggtggtgtcccgcatgctggattttggtgttgttgataccttttatcagggatttacctctattctagtagttttgttatggtactattttttatctggtttatttaactggaaaagcattttgaaaatactggttttagcatttcttttgggagtattaagtgtttttgttgcagattttattcttctaatcatggtattgattaattttgctagtcaatttattcaaaaaaatttgttggattatgataaaagtgggattttgctactagttgtaattatccaagttttaattggtaatattgcaatgtttctaggaagaatgagtgttagaggattgtataatgtctctaacctgatgggtgtacagtactacacacatgagctattaatagtatatgtaatattcgttattgctattaattatgttgttttatttttctatagacggtattctcataaaatagcgagtgttagtcagaagataaaggaattaaatttaagtaaatcgttatttgagctggttctaatattttatgttgctattgaaagtattatgttaataagcttaaatgaaaatattacggcgaccattcaattaactttaataacttcatttattgtgatgttgcttatgatgttgtggcagatggttttttttattcggtcatatatgaaaaagcaagaagctagccaccaggcgaaacaaaatacacaattaaatgaatatttgaagagtgttgaacaacaatatcttgagctaagaaggttcaagcacgattacaagaatattatgttgtcattgcaagactccatatctaacgggagttcttcagaacaactaccatactttaaagaattaattgcgcagagcgctatcgacacgtcgttagataatggtaagatagctaaaattcagtacattggtaatgaaacattacggggattaattgtacagaaatttttcgatgcccaaactaaagggattgagctgagtctcgaacttgatcagagtgaattcataattaagcataatttggtagatgttgttcggattgttggtaatttattggataatgcgattgatgcggccaagtctactccagataagcaggtaacttgtgcatttaactcgctacacgaaacgaaagaaatttcagtgagaaattcaactaataagaaacttgacgtgaataagatgttcgaattaggtgcatccactaaagggagtcagcgaggctttggcctatcaaatgtgcaacaattggtagacagacaaaagaattttttcctggatgttgacagcaaaaatgaccgagttattataactttgacaattttggaggaagaatgattgtttccaatttatttatacgaggataatgctgagcaaagagataattattgtaagaccgtcaataatacaattatgattaatgagtttgcaatggagcttagggttgcaacggatgatcaaaaaataattctagcagatttgaatcaacaacaagatggccttttctttttggatatggaaattggtgaggacaaacagactggacttgaattagccagtcgaattcgggcaacgataccattggctaaaatagttttcattacaacacacgatgagctatcgtttgtaactctggaacggcggattgcaccgttggattatattttgaaagaccagtctgctgacctaattacgcaaaggattattaaggacatcaatgtagtacagaacgaattaaaaaagactaatagtcagcgcaaagatgtttttaactataagttaggaacgcgatacttttcactcgcattagatgatgtgattttgttgagtacatctaaactgcgtccgggcagcgtacaactccatgctattaataaggttgctgagttcccaggaaatttaaatgcgctcgaagaaaagtatccgcaatttttccgatgcgataagagctcgttggtaaatttaaatcatttgcgaagttttgactataaagaaaaagagttgttgctcgacggtgaaattaggtgtaaggcttcgtttagaaagtcgcgggaattgaataagttgttgagagacaactagttttttaatattatttagagcttctgtcagtgttatttgacagggctcttttgttatgaatatgaaatctgattatataatataggcgctgaagatagttggagtagggctctgtgatcttatgagtattaaaatgactaaaaagtaagcacagtactcgatcgtaaagtatattagcatagcgttaagacgtgaaatttagttagcgatatgactagctcttagcgtaacccaaaacttcagagataattgaaattgtagtgctgcaaacaataatttataggaattcagaatggatgattactcgtctattttatcttcaatatttaggatactcaataacttccaatgcttagaggataggataaacgtagcaatgccaatgaataaaatatttagaaagagcccctttagaagagcttccattggcccgttaatgggtgattgagttgggtcaataccttgagaatagaaactagaaaaatctatcaaccaatggacactaatggcagccagtaagcttccggtttttaaatagattgctgcaagtaaaatacctaacccaataacatagagaacctgacacaatactgaccatacgggctgtgataaaaggttgaccaaatgcatagccgcaaaaataagcgaagcagtcatcatcgaagcgatggtggcctgcaatgtggcaaattttttaaggtttagtgctaaaagcgttctgaatatcatgccacgaaaagcgtattcttcagttatcgctacaatcaacgaaagtaataatgagattaaaaattgatacatgtggtttcgaaagaaaataagtagaaatattattgctaggctcaaaggcagactattcttctttaatattgacatgatattaacgggtagccagtggataggttgcttaacatatcgcctattcagaatgattatcgcgattaatataatagattcagttaatatgaattgaaagggtccgtcttttattcccataatatcagtcaaaggattcattaaaaagagcactattaggtagtaaatagctgtgattattacttttattaatggcatagttaaaattccccccatataaactaaaaaggctgagcactgcaggcccagtcataaatcgagtgctttcttatagtgcttaaacttgatggcttgaactatccgtggatgaatcctcggacagcgctaatgacccaatcggcaggcccaacagcacttttataattattccgaacgccacgcgcgctataggcatggaaaacgccacctgaaatagcatttaattcacggtcacgcaaaactagaaattttttcataattgttgatctcccccaagaaaattaacgaatacttttcaaaataccacgaatgcctgcaactgaaccaatttcatcaatgtcgaacacttttaccaaagttataaccgccccgattaaaaccaccagatattttggcaagctttttttgcggcaacctggaatattgtaacttctcaaactgtagcataaataatcccccttgtatgatgttatttggaacaaatttagtttaatttatttttttaccagattgttgaaaaaattataaaagtaaaaaaacgttctcttaacgtcaaatggatatactcctctttgggtagacaagcaaataatcaaagcttgcctacctaaggaggagtttttctatgggcagaaaaggttctcgctatacgatta

SEQ ID NO: 22 - DNA, 15657 bp, synthetic construct
  source 1..15657: mol_type = other DNA; note = Lactobacillus plantarum PDG8 - contig 22
gggtaggacgttgccatgcgattattccgacatagctcagttggtagagcgcttgactgttaatcaagatgtcgacggttcgagcccgcctgtcggagttatctacggtaagccatggagagttgtccgagtggctgaaggagcagcattggaaatgctgtaaacgggttatacctgtttcaagggttcgaatcccttactctccgttagttagatataataaatatgaccccttggtcaagtggtttaagacactgccctttcacggcagtaacatgggttcgaatcccgtaggggtcattatggaggattagctcagttgggagagcgtctgccttacaagcagagggtcacaggttcgagccctgtatcctccatctgatgagagttactcatcaataatttaatagactccatcatgaagaatgatatggctcggtagctcagtcggtagagcaatggattgaagctccatgtgtcggcggttcgattccgtcccgcgccatttatggaggggtagcgaagtctggctaaacgcggcggactgtaaatccgctccttcgggttcggtggttcgaatccactcccctccattctttatagggatatagtttaatggtagaacaacggtctccaaaaccgtcggtgtgggttcaactcctactatccctgccatgatggcggtagtggcgaagtggttaacgcaccggattgtggctccggcacgcgtgggttcgattcccacctaccgccctttgattgggttatagccaagtggtaaggcaatggactttgactccatcatgcgctggttcgaatccagctaacccagttgggtttgggcaataaatgatggcggtatagccaagtggtaaggcagaggtctgcaaaaccttcatcaccggttcaaatccggttaccgcctttcctgaaaaggttataatcctgatcagatttatgttccatctagttattattttgccggcgtggcggaattggcagacgcgctggactcaaaatccagttcccgttgagggagtatcggttcgaccccgatcgccggtactaagaggttttcaggaagctctaagtacctttaagaagtcgttatatcgttgatataacggcttttttgtattcttagaatcatgcgaaaataggcaaaatgatttttgggtgaactttccaattgcaaagaataaatttacaatattagcattgcatgaatatgaacgtagaaatagtctcgtaagcatcgaaaagccctgtattagcataaatcatgctaacatagggcttttcatattatggtaggtctttaaaatgaatcaattcatctaaaacttgctcgttgcactcggtgataactgaaatagttggtttaagtccatggtgcttgttctgctttgtgactcgctagtgagttgtaatgtgtttctgaatcgcagctagtcaaataacggtaacggtgccaaaaaatcgatatctgttcgttcgctggcggcgccttctgctaaaattgctatctgcttgaccacttgggcgccagcttggtgtaggagggcgttggcagctgtcaacgaacccccactgctaatgacgtcgtcgataatgataacgcgcttatgattgattagtgcggcgtcagtaccgtctaaaactagctgttgtggggtgctggtcgtaattgcgcttaccggttcgataagcgggtgctgcatgtaatccttacgattcttacgtaaaacgataaagcgagggtggtttgtggcctggcttagtgcctgggctagcggaatgcccttactttccatcgtgactaaataatcaaatttagtggtagttagccgttgactgagctgacgggcagcatagtcggtcagctcagcgtcgcccaatagaacgaaagaggcgatgctagtcgtggcatttaatcgaatcaatggtaactgccgtgtcagcgatcctaatgttaactgataagtttgcatatttataaccccaatccaattaatggtaaaccaaattttaggagtgccccggtcattagccccgcgaatggatcgacaagggcggtcacgacgagcgttacgcctgcaaccgtacttgacgagccgtgcaaagcggtggttgcattttccgggaaaatgacaatggtccctaagataaacaaaaaaccggcgattgcagtgctaggcacaacttttcccagctttggcagccatcccagtaatagaatcagcatcatgatcaacatcattaggatacccgcgattactggttcaggcgcgctggctgtcgcggaaataatcgtttctactggcgcaccacccagaaggctagttcccaggtctgctaatgcctggctactagtcagtagatttagattgaccgggttggggtgttgtcccgtcatttggccagtaattaagccgtacgagaggttagcaccgatattaagacaagctagactcagagcacctcgcaggattttaaaactgaactgtggtctgacaaattgtaatttgcgggtcgtcacgtgttccggtagtgcgacgcgataatgtgtcgtcgctgcgtaacagctggttccaatcactgatacggcaattgtccatactaaatctttactgatcaaataagtcacacccgccaagccgattgacagccacccaaattggggttgttcgtgcgccatttgcaacgcgattttagccaacatcaggccaactcctgccatcatcgctgccataagctgattgcccagactatgaacgatgagcggcagagtaccggtcaagccaatcacgaacatcatactcgcacctaaaaagataatcgacgaccgttcgcgtaaatcgtgtcccaggtgcccgactagtgcgagggattccgcttgaaatgaaaccggtgcaactgaactagccacgccgttgattaaaccaactaatccgaatgaaaatgcagtcggaaagaccgcaaaaccgagactcatcgccataattccttgtgggatcccgtttaaaacgaccccgattgctgccaatagatccgccaaccaatgcatattaataccgccttttttgtttatacgaataatatacgactgattagggtttgaatccagtaaatttaggataaaatcagaataatattgtttgttaactatttatagttcgtgtttttgcaaatcacgattagttggcgcacgctcgcaaatggggtatacttagtgctaattagtgaaggaggggtggcaccatgccaacgattaaagattattacttgccaaagcggccaacattattattttcgttgcatccagaaccaacacaagcgattatcaatggcaccaagattctggaatatcgtcggcgtttttttgcacgtccgtttcaagcatttgtctatacgacaggggctaatgggggaattcaactctttttgcgttgtgagcagggcatgcaactcgtgcctgaacaattagcgcttgtgggcgcattgttacagcataacgcgcccacaaccaccgcggcttattttgaaggcgctaaagtcggattggcgttaccgattacggcttttacaaccttacctaacattccgttggcacagttacgtcgtcagtttgaaaactttgttacgccgcggagttacgtcttcttagatcagcctgaccggcaagcacagttggattggctattaacgcaaccctgtgagtcgctaactattttggactggcgcaaacggtatgcagcactggcgactttgttacaaaaatgaagccaagcttgtcttaatcgggctgcaactagtgcgccggttataagaatcaaacagccactcgttgtgtatttgctgagcaaaaggacttagctgtgacaactgccgcaaacgagtagtcatttagcatgactgattggatttgatcgtaaaaaaagaacctgccacaagtggtcaggttctcagattaattagagcattttttcatagacgtagcaaacgtcatcgacatggtatacaccgaccatttcgccaactcgcttgaagttcatctttgcaatcagatgttgcatcgcttgattgtcggcatgagtatcgatacggatgctcttgatttcaggatgatccgcagcaatatgagcaatgattttttcgaataattgagtggcataaccatgacctgcatggctagaatgaatcgcgactcggtgaatcacgacgtaaggtgccgtggtatttaaccattcggccttcgcagtatcgtaagtttcgtctggtgaaggcacgacagcgacagcgccgaccgttgcgttgtcgtcggcattgaataagtatgctgatccttgcatgatgtcggccgtgatttgtttgcgagacgggtagtcgccttgccactggttgaccccagcttcagcaagttgattacggccgtcactcagaatgtcgatgatcgtatcgagatcatcgagggtcgcttttttaaagtacataattctagctcctctcttgaacagcgattgactgccgaagcagtaatcgacttttaaaagtatacagaatttttagaaaaatgaaactattttctaccgattcttaggagattttcagtgacgattttcaagtaaaatcttgcgcgcttctcgggccatgtcatgttgcgtattataagcagcgaccgcactcggtgcatattggtaagtattagtccgcaaagtttgttcatagaattcgaagtagggtaagtgggtattttgcgcaatcgtgatagcacgctgccaatcgaaatctacggcgcggtaatcaacatgctggaggccagtctcatcaattgtcagaagcaagtagtttgctcgtggttggcgtaggtggggattaatggcagtcggaagaccaactgtcccggcgtttagaatcaactgtcccgtggttgcgtagcgcatgatgggctggtgtgtgtgcgcgtagatgacgatatcgacatcgccttcagcggcttggtcaaagttggcctgactggcagttggtgcgagcgcgtgtccactagcgacggtcggtaaaacgtgttggagacggatggttaacgggccgacgtgtttgatgactgtcattggtaagttcagtaaccgttcaaagtgtgtcgaactcagctggcgccgatcaaaagcggtgagaaccgttgccataatttgtttgggtttagtaaacgtgttgggattggctgccattactttttggtagttttcctcgtgatttccgagaacgtaggcggtggggtgaacgcggtctagtaaggtgagacagcgctccgattctggcccgcgaacggtcatgtcgcctactgtccagtattcgtcaacgtgttgtttctgggcgtctgctaagactgcttcgagtgcagtagcgttaccgtgaacgtcagataggactgcaatttttaccatgttgagatgcttcctttctactatgtaatctaaactctggtgagatgttttattctggtaaacgtgggttttaaaaatttatgaatgtaaccactatgaaaagccatcgtaacttttatctgttataatgggtatgaaacgaagtaatatatagcacgtatattcaagccaattcgtttcgtgccgtggttatccttgcgataatcacggtttttattttaccatagtgttattaagtgtctggttaataattgtcaattcagatgtttatttttgcaagttctaggtatttgaataatagcatgttaaacggatgaatgggtgccagcactaatcgctaaggaggtagcgtacttgtcaacaagatttcaacatgaaatagtcacgcgtacacagcccttatcagcttgggttcacttgcacgattctaaggcgccacagcgaattgcgccacactggcatcaaggtatcgaactttcgtatacgctcagtggtcacattgacgattttacaatcaatggtcgagattatcagtctaaatcagggtcaatattagttgtgaattcacaactaattcatagcgttcgaacgatcaatacagcaaatagttgtgcgttatcaataatctatccgtacgattatgtgcatcgactttatccgtccattgagcatgaagtaatcgcgattaacgaaccagcgtatttttcagagcagcagtcggcggtatacctagatttacagggagatttatatcaactagcactcgcgttacaacagtcaactgcgtatacgaacctacgaattgaggcgctaacaactgcaatcctccaacgcttattgatctattttacgacggctaaggcaagttctggtgtgatttatgggaaagcacctcagattgttgagcgaattcaaaaaattaccatgtacgtcaatcaacattatacacagccaattagcttatcagacatcgcgcaacagattaatgtgaccaaggaatatttgacgcgcttttttaagcaacatatggagatgacggtaggagaatatattagtttggtgcgtgcccaacatgcctatgaagatctgctaggtcagcgtggaaatttgaccgcaattgcgacgatgaacggttttccaagtacgcgtgccctaaatcatgcttttcaagcggtgtatcatcaaactgcagcgacaatttacaaaactgaacatacattagactaactgtttatggacgatgttctgaaagaggtttagattctgctactaactggttgatattgctatattaatcggctagtagtttttttatgatagagccaataaatggaggcgcttacaatgatatcaaaagaattgagtcggtcaataattgaattgcgaaccgcatttaagaaaaatgatgatgcgcgtgacgctgggttacctcgtgaaatggctggtgtcgagagattagataatctaagttatggtcctgaccccaagtggcatttgttggatttatatcggcctactaaggtcattaaaccattgcctgtgattatcaatattcacggtggtggatggtgttatggcactaaagaaacttatcaattttatggtctgaattgggcccaacgaggatttgccttcgttaaccctaactatcgtttggccccagatgtgacttttccaggtgaattggatgatgtagatcgttatattcattgggtagcggaacatgcagccgaatataacctagacagtaataatgttttcttgattggtgacagtgcaggtggtgagatggccgagcagtatgcaacgattctgactaatccggaatatcggtccaagtttggttacgagctaactaatctgaaatttcgcgcagtcgtgctcaatagtgcggcggcatttccgctagacgaaggcatggtgacaggtgcagttgctgcatactttactcccagcatcatccgtcaacaacgagaacagattatggcagaaaactacattcagaaaaattatctgccaacattcatttgtacggcgacagcggactttttgcgtaataacgcggctaagctcgatggattcttaactgccaagaaagttgaacacgtttttaaaatgtatggtgatgacgatcatcctcgcgggcatgtttttctgattagtcaaaaggatgaattagcacaacaagcgacggatgatgaaatgcgctttttgcaggaacatatggcctgatctaatctggaggaaaatatgatgaaggacaaacaaaatcatttattgtttaaagtttcattattatcaatttcattatttttgatgatggcgccgcaaatttcttcggcgctaccgttgatgtaccatgctttcccgggaattcaacaggccggtgttcagacgcttgcaacgattcctaattttggaattgtggcggggctgcttgtcagtccgttgatggtccgctggtgtcatgaaaaactaaccattgttattggcctggttgtcaccctattggcagggacctttccaatgtacgccacggcctacagtgcaatcttagtttcccgttttctaatcggtgctgggattgggctattcaactcactggctgttagtttgattccacaattctataagcgtgatgaaaatgagttggcgcaaatgattggctatcagaacgtgatgggaagtgttggggccgccattgcctcattcttagttagttatttagtaacgatcagttggcatgccgcctttgccatttacctactcgttattcccgcgttgattttatttacattgtttgtgccgttaccacggccagttatacaggcagctagccaatccaaaaaggcagcgacagtcacacgaaaaatcaatatgccagtcgtggtaattgcagtgttgatgtttttagtctttatgttctacatgccgttttcttatgaattaccaagcttgatcgtcgcaaacggtatggggaccagtagtacggctgccttgattgctggattatcaacattggtcagtattccagtgggcgctagttttggcttcttctttaaacgattacatgatcgtattttcccgttgggttttttgctagttgctgtgggcttcattctgattgcagttgcaactaatattgtttttttattcgttgcggttgtgattctgggctttggttttggtatcggtgtcccatacttatacaattggttggactgggcggccccggaatcatccttgaacttggcaacgacgattgtgttagtgttggtcaatattggttgctttgtctcaccaaccattatggatgtgctggctaatatagttggtcatggcacgccccggggagttatgatgttgagtggcgttgcctttctacttatagctgcctatgcgctcggacattatctacatgttcatcaagcgcaggctaacattacgggtggtacgcatgattaataattatttatgtcttgatattggtggtactagcctcaagtcgggactgatagatgcgaatggtcaattgcagcagtcacttgatgcagtgccaattgccaaaaataagcatgatttttggcaccagttaacagcaactatcgaccgctttcaagggcgctttgcgggaatggcaatcagcgttccgggtcaagtagacccccaacgcggtatcattcaccatggcggcgcactaccatacctggatcaatgcaacttacaggaatctttggaaaaccattatcaggttccagtagcggttgaaaatgatggtaaggcggcggctttagccgaaaaatggcgcggaacattacaatattgccaaaatggtttagtcttagtgcttggaactggggttggtggtggcttaatcattaataatcagctctatcgaggtagtcattttcaagctggtgagttgagtctgatgttagccgcaacgactggaactaatttcaaaataacgggtgagacgggttctgcagtgaaaatgattacggcaattgcgcaccaattacagttacctgatcgacatgatggtcatcaggtgtttgccgcgatagctgacggcaacccggatgctgaacgcatctttgaagcttatggtatggaggtcgcacaaattatcttaaacgttcaagcagtactggatgtaatgaccgtcgcaatcggtggtggcatcagtgctcaaccgagtgttgtgcccatgatccgtaaacagtatgcggcgctgctgcaacagtatcctgtaattggaacgactttatcaaagccagagattgtgcctgctaagtttcataatcaggccaacatgattggtgctttagcgggactgctgaatcgctgaatatgactgactggcattgtttgtgcaactgtcttcttcaaaagttctgtcagtttttagcaaagtaaaagataaggacctcattttgaatctatcagaatggggtccttattgaaataacggggattagattgccaatatattgcataatctcaaaacaagctatacaccaaataaatattcaacaccgtaataattccggccagtccatatcccacccacgttaccgccgggcgattaacgtgggccttcatcaggctggcgtcatttgtcagcgcaactagtggcaacaaggtaaaggggagggcgatgctgagtgccacttgcgcgtaaatgatcaagttttcaaaggcagtgtcactaaagccgactaacataccgataatcagaatcggaattagcgtgacagcgcgagtaagcagccggcgttgccatagcggtaagcggatgtgtaaataaccttccatgacgatctgaccagctaaggtgctagtgatggatgaaattaggccggtaattagtagggctaatgcaaataaccagctcatgaccgggctagcaagggcgccaaccacggtggtactttttaacccatcgaagacggcctgcagactcgctaacgcgttggtgtgaccgaagaaaagcgtcccaccaaggacgagcaaaagtgcgttgatgagaaaagccgcaatcaagtgcactgttgagtcccaattggcgaagcgcagtgcttctgtgacttgggctggattatgataatcataacgccggctttgtgcaagcgatgagtgtaagtataagttatgtggcatgatggttgcgcccaagattccgagactgaggactagtgcggtatgatttttgacgatcaatggtgttggaactaagccgagcaacacgttgccaaattgaacgtgggcccgtcccacctcgataccaaaaataatgccgacggtcaaaatagcgacgaggacgattacttcgacacgccgaatgccaaatctcaaaaacaacaagacaactaagacgtccgcaatcgtcagtaaaattcctgcaagtagtggtaagccgaataacatttttaaggcgattgcggttccaattacgcccgtcatatcagtcgccatcatcgcgacttcgtttaaaatccacgcggcgtaacgcacgggccggggcagcttgctagcgatggcttgtgctaagtcttgccgggctacaacgcctagcctgattgccaggccttgcatgaacatggcgacaatgatggctaatgcgagcacggctaaaagccggtactgaaactgaccgccaccggctagggatgtcaaccagttgccgggatccatatagccgactgccactagtgcaccgggaccgctataggctaaaaatttgcgccaaaaggccgtctgatgaacgtcgggaaccgcgacgctctgattgatttcttcaagactttgatgacgatgcgattgcatggttcgacgcctcctgcttttggatagcgaggtcagccagaaattggctgaagccggtatccttattcatcggtggtactaagtcaaaccgatcaccaccgcttgcccgaaaggtttgataattttgaacgtagtcttcctcgagggtttccaagcagtccacgacaaaggatggcgtaactactaatatgttgcgtttgccaagttcgaccaactgcatgagctcattttttaagtaaggcttcaaccacggcatcggtccgaacttggactgatacgccgtaatgaccttatcagctggtaattctggtcgctccgccaacacagctttggtcgttgcctcgcattcgcgttgatagggatcaccatggcggaccattgcagtgggaatgctgtggtagctgaagatgaccgcatcgtaatgatgcgcctgatagctttgccagactttggttgctagtaagtgaatataggtcggttggtcgtagaaactgtcgataaagatgtgtggtaatccagttgcttcaacttgacgatggatgccgccgtgcgtgctctgggtgtattgcggaaaaagtggtaaaataattggcttttcacacccatcagcaaccatggctttcaaggtcgcaccgatatcgggttgaccgtacgtcattgctagtcggacgtcccaatcgggtaatgctgcttgtacttgttggcagatggcttgactgtagacgattaatggtgagccttgtgggagccaactatcctgataaaaggtggccgaacgccaagaacgggtcggtaagataataccacgcaacagcggttgccagagtgcggctggcatctcgatgacgcttggatcacttaagaattcttgtaagtatgttttgacatccttagtccgtggggatgctggggagcctaaattgacgagtaataatcctgggtgcatagaaacccctccaatgctcttgataaattaatcatagcataatcgtcagcttgtatacggggttaatggtttatttattcgattatctagtgataatcaatttactgctgaaataaataaaatctcttgctagcaactggccgggctagcaagagatctgaaattgatatttggttttgttgcagttcaaaaatcggtgtcgtcggctggatcgtactttaaaagtagattcagaaatgccagcaaaagccatgaccatgttcgtttttaggtcgtcaacatcaaaaggcgattactgggtggacttggtgagttgagctgactaatgggcttactttgcggcgtgggtccgtcgataacgttgattgagatagtagcctagatagcaaatcgccacgaagggaatggtgtaatacaaggcaatccgctggttagggtcaaaccaaatcaagatacaagagagcccacttaagataaaggccagccacgggacgaccgggtagccgggcgttttaaaggtcaattgatcaagcgactgcccacttttcaggtaggctttgcggaagttgatctccgaaagggcaattgccatccaaacaatgacgacggcaagtcctgaaatggatactaagaccaggtacaccgaaccggcggcatagacactcgacaatagggccagaatgccacccagcatgctagtaattagggcgactaacggcacatcgcgcttcgtggttcgtttgaaaacctttggaatggttccctcgtttgcaagtgaccacagcatgcgggtagacgcgtagaggccagaattagcggccgacataatggcggtcaatacgacgaaattcattaaatcagcggcgtagggaatcccaatcgctttgaagacgagcacgaatggactttgcgtcacacctgcttgtttgtaaggaatcagtgcggccatgacgaacatgctaccgatgaagaaaataatcaggcgccagagggtcgttttgattgcggtcggaatggtgtgggccggatccttagtctcaccagctgtaattccaattagctcagttccagaaaaggcaaagttgaccgttagcatagttgtaaagacgccaccaaaaccattggggaaccaaccgttacgcgtatagttgctcagaaacggggcactggtatgaccgtgaagtggcaggataccgaccattgccagtccgcctaacacaataaaagcaatgatcgcgatgactttgatactggcaaaccagaattccgcttccgcaaaccagcgtacggagagggcgttaacggtgaagatgaccaccataaagacgaggctccagatccaggtcgcaatgtgcggaaaccacgtttgcatgatgagccccgctgctgtaaattctgaaccgagggcaatcgtccaagtcaaccaatataggatggcaaccgtaaagcctgtgccgggaccaatatattttttcgcatagacgtgaaacgccccggtgtagggcattgcaactgacagctcacctagacagagcatgacgagatagacgaggatggctccaatggtataggcgagcagagttccaattggccccgcttgatgaatcgtgtaaccggaacttaaaaataatccggtcccaatcacgccaccaagtgaaatcatcagcacgtgccgtgattccatctggcgactgaggtgggtttgttttgacataatgtaccggccttccttacttgcagaattaatatgattagactatgattagaaaatcaacaatgctattagaataacataatttataagtagaaaggaaggcaattattgcaatgctttcattaactgaacaattgaaccggggcccggtcgtctcggacggtgcgatggctacggaattagaaaaacggggcgtggcaaccaatagcgcactgtggtcagccacggcaatgttggaccatccggatgcgattcaagcggtccatcagagctatctggatgcgggcgcaaaaatcatgacaactaatacataccaggccaacgtccctgcatttgagcaggctggtattgctgccgcacaagcgcgtcaattgatacaacaggcggtgacaattgctcatacggcgtgtgatgctagtcatgtcacggatgctgtgattgctggtagtattggcccgtacggtgcttacttagcggatggtagtgagtacacgggtgcatatcagttaacgccgagtgcctatcaagactttcaccgcgaacgcctggcgttgatcacggccgccggggtggacgtgcttgcattagaaacgatgccacgtttagacgaagtacaggctttggtacaactaatcacaaccacttggccgcaacaaccatactgggtaagctttagtatcaaggatccacagacattatgtgatgggacgtcattagctgtggccgcaaagtgggtggcggcccagccgaacgtggtcgctgtgggggtcaattgcactacgctggaaaacattgcaccagcgttaaccactttgaaggcggctgtagcggttccgttgatcgtttatcctaattctggtgatcaatatgatcccgtgacgaagacttggcaagcaactcatatgagtcatcaatttgcatcctttgtcccccagtggttagccgccggggcccgcattatcggcggctgttgtcgcacaacgccgaaggatattgcgacggtggcacgggctctcagtgtttcggattccgtcaagctttgaaaaatgttaagaaatgacggtgttttagttcatggtgggcgtgtctcagagatctaagttgtcttgggatgttcattacacactaattattgatttaattatatttgaggaaaacaataactagcgtgctgagcgtcactaggtatggctagcaatttaattgaaactggtgaaaaatcactagtcgggcactgctgatacggtagttgttcacgactagcgatttttgtatgtcaataaaactgttcatatcttggtcgagtaacataaaatatggtagggtaaagatagtgtatagatataacagatgaagtggtcaatcgtccgtgcgtactcgaagtttttgaactcggtgacaggatgagttgatttttcagattgagaagggaacggctaggtgatgtattattttgtgggtactggtttaggattgaaattgacgggaattgaaaaggcacagttgaaccgactggcgctatttgacgccactggttatcaggctcgatgcgtctatgtcacttataatccgcgtttacatgagcatgcggcccgctttggtgcggaaggaaaatgctttagtttggtagattgcaaatttaatccgaatttttggacaaatttgtcagcataacctgatacggtgtttgccagtcgagtattttaagcggtcgctggttaatt

SEQ ID NO: 23 - DNA, 11311 bp, synthetic construct
  source 1..11311: mol_type = other DNA; note = Lactobacillus plantarum PDG8 - contig 23
ttatagtgatttgagtagatttgttaaatccattcccttcaggtgtgaagattttaaattagttatagttgatagttttaaggataataatactaaaaatattggtttaaactttagtaaaagcgttgatgctgattttatttctgtcgacaataatggttacggttctgggaacaatgctgggataaagtatgcattagataattatgaatttgactatctaattattactaatccggatgtggaaattgagaagattgacttatacgatgttaaagatgatgtggtaatggggccacaagtaattaatttaaatgagaaaaatcaaaatcctcattattacaaaaaagagagactaggctttctagtaatgcgacactatgtggtaagtgaaaacgctttttggttatatttgtatttagttattaataaaatatccaagtttttttggaagacttattttactatttttgataaaaaaataaaattaaacgtctacgcgttacatggaagttttttttctatgacaaaaagaactgctaaaaaattagttccattatttaatgaagagatgtttctgtatgcagaggaaaaccatttagcagaattatcaaaacgaaaggctgttacaatgatttataattccaattggattgttaaacactttgaagatggaagtggggcaagtgatagtcaatttactcgagaaaatactctaaaatcgttacgtgttttttttaaaacctggaaataactacttagtatttaattatggaggttaatttgataacaattcagtttatttcaaaaattagaggattttttaatcatttaattaagcaaaaatttaatgatattaggtttgtaagtgccaataaaacatatgaagctgtgagctggaagcataagcttcagtcacgtttaattaggagtaaactagcagattttctggggattattcaaattttaaaattaacaaatagtgactttgatattgcaggtagttttaatagatttgttttaggggataagccatactttatttatcttgagaatccaactgccctttatcactacaaattggaaagaaataaaacttttctcggtaagcggaagtttattaattctatgagaaataataaattgaagtctattatatgtatgtcgaaagcttgtttttatgaagagaaatctatagtagaaagagtcaataactcagtttcggtcaaagtaatatatcctctggttccaagcaatgactatgtgaatagtgattttattagtaaacggagttattcaaaaaagttaaaacttttgtttgtgacacaaggctcaagatttgtttctaaatctggtccagaaacagtacaagttatgcaaaaattaaaggatattaatgtagagctaacaattctaacagagcgaaaggatatcccgaaggaaacgttaaagttgattgaaggctcgtctaatatcaacctattagagtttggactctctttctatgaaatgcagaaactttatgcggaatcgcatatacttgttcatttaacaagtgatgatagttttggggtaactttgctggaggctatgaaggctggattactaattatatcgactaatttatatgcaattcctgagatggttacagataattataacggatttttacatgatcctaaatggtggtttttttcggcggataatacgcctaatccgaatatttggaatcatcgaaaaaagacattatataacactgatattatagatcatgaactaattgattttgcagtcaaacatattaggaaattatataaaaatagggatttattggctaaaatgtctaataactctctgaaacgcagtagtgatgaaccgttctcagacatatatattaagcaacagtgggaaaatgaaatgattaatatcatgaaaaggagttaaataaattgaaaataacagtagcgggcacaggttatgtgggtttatcgttagcagttttattatctcagtataatacagttacagcacttgatgtagtaccagaaaaagtagatttaatcaataataaaaagtcaccaattgttgatgattatatttctaaatacttagatgagaaagagctgaatttagaagctactttagattataaactagcattacaggatgccgattatgttattatttcaacgccgactaattatgattcagaaaagaattattttgatacatctagtgtagacgatattttagaaaaagttaccagaattaatcctgatgcagttgtcattgttaaatcaacaattcctgttggctttactgaagaagcgcgcactcgttttaataataataatattatctttgctcctgaattcttacgtgaaggtaaggctctttatgataatctatacccttcacgtattattgttggcgaagattctgagcgcggtcatgtgtttgctgggttgttgcaagaggctgctatcaaagaaaatattccaactttatttgtatctagttcggaagccgaatctattaaattattctcaaacacatacttagcaatgcgcgttgcattctttaatgaattagatacgtatgctgaagttcgtggtttggatactaaacagatcattgatggtgttggtctagatccgcgaatcggtgatcattataataatccttcatttggctatggcggttactgtctaccaaaggatactaaacagttattggctaattatgacgatgttcctaataatctgattcaagctatcgttgatgcgaatgcaacacgtaaggattttattgccaatcaagtattagctcgtaatcctaaaaaggttggtatttatcgtttaacaatgaagtctaattctgataattttaggcagtcatcaattcaaggaataatgaagcgaattaaggctaaggggattgaggttatcgtttacgagccaactttaaaagatagtagattctacaattcggcagtggttaatgatttagattcttttaaaaaagaggcagatattatcgtggctaatcgtaatgcagatgaattgtctgatgtaatagataaagtctatacgcgtgatttgtataatatggaataacatattttatggtctcttagcgaagtaaaaccgaggagaaactcatgaacgttttaaaaacaaacttacaagatgtccgcatcgttgaaaccgatgtgttcggcgattaccgcggctttttcacggaaacttacaccaaaaataaatttattgcggcggggatcgacaacaacttcacccaagataatcaatccttgtcggtcgaacctggcgtgttgcgcgggatgcattaccaattagcgccttatgcgcaaactaagttattgcgcgctattacaggggtgatctatgacgttttagtggatgtccgtaaaggttcaccaacatacggccggtactatcccctgtcaagttgacacttataaaaacgaaaacacaatttttcttatccgaccaaatcgtggtaatattccgccacggtttggtcatttcttttagcggaaatgaactgattcgtgaagtacattattccagcacgaacctgttcctgtaactctgctagagtttgcgcctttggacgatgctcgagccagatgcttttaaaatctgcccaccagagttccattacggcgttatccgctggtgtcccaggcgccgataaccttctcctgacggagagcttcgttgtaattggtggacgtatatgccgctccacgatccgtatggatcatttctggagtggttccactagccttagcggcttggttaaagactttgattgccgcttcacctcccggttgcttatttcgatcaatttttttgagaaggcaatctgaacctctctttcacgtaatttagctttgaggtcccgaatctctttgagtaactgttcctcacggtcggctggttgcctacccctggtcttgccacgccggtcctttagggccgtccaatcgtttgcttgctcgtatttctgcgtccaggcatacgctatggaataggtaatatcaaacttttgcgctgcttgcttgtagtcatgattatgcttcaagacccatttaacgatttcgattttctcgtcatacgagacctttcgtcccatcttccgcacccgctttcttactggttctttaccattattgtaaaggatgacccagttacgaagttgggataatccacggatatcatactttaataggatttctttggtaggaagacggtgatttcgataatcacggacggcacgaagcttaagcttcttagggtaccggcgattgtgtactgggcgctctaaattagccaatctgccagttagatactgctggatccaacgctttaaactccctgcacctacattgtgataatcagcgaatggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagactggcactggataaacacattcctttttgagggaagcgtgaaaggattccattggcgcattatcatacggacaacccttacggctgtatgagtggcggatatgtagttcagttaaacgttgattgtaatcatcgctggtatactgtgatcctaaatccgtatggataatcaggtccccagtaatggttcgatttttaaccgcgctttcaagggtctttaagactaaatcagtagccatcttttttgagaacgaatagccgataatccgtcgtgagtgcaggtccatgatggttgataagtaacaccagccatcacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcgtggactgcaccgaagctgcagtggttgaagttccagattcaattcatggtggatcttcataacaccgtatcgctgcttaaattccgcaaagattcgcagaatccgttgtttcaagcccgcatcttcggcccggcgttttgaaggtttgggggatcgataacgataatactgagctctggaaacaccgaggattcggcacatcttggttacctggtggtgatggctttcttggtgaatgtaatcaaagatattggttacttctgcgcaaggaagcccagggctttttttaggatttcgttctcctcagacagcgaagccagtcgcttttccatcgctttgatttcgtctggcgatttaccggattgagttttggcctggccctggatccacttatgaacggttgaatagccaatgccatattctctggccagttgggcagctgattcgccttgcttatataggttgataatgttttgtttgaattctttgtcgtaacgagttggcatgtaaaaattccttccttttgagagatgatttattcattataccctctcttaaaagttgtctcaggaatcagcttacatccatttttgtccgaacagcgttcggattaattttacaatctaccgtttactaacaaattttataattaatagaactagccaggccacaacttaacagttgtggcctgttttttgatgctgtataattaaagggttagaaccgtgtcattacttaatgacataaacaaggagagaaaaagatgaaatatggctatgcgcgggtcagtaccactgatcaaaaattagcaaatcaaattgagttactaaaattggcaggagcagaaaaaatctttcaagaaaagtttaccggcacaactactgaacgaccggagtttcaaaaactgttgcgcgttctaaaaacaggcgatactttgattgttactaagttggatcggtttgcacggaacacgcgcgaggccttagccattatccaagagttgtttaaagaaaatgtcaaagtcaacattttgaatatgggcttaattgacaatacgccgactggccaactagtctttacaatatttagcgcctttgcgcagtttgaacgcgatatgattgtcacgcgcacacaagaaggtaaattgtatgccaagcaacatgatccgttgtttcgggaagggcgaccgaaaacgtattctgatgaacagatcagatttgcttatgagttgcgaaaacaaggcatgacttataagatgattgaacgaaagacggggattagtaaacgcacgcaacagcgaaggtttaagtcgatttaatttaagaattgaatgtttaattaatcacgtacgacggggattgccgctttattaaacagttgtgagagaagtttatttagggattttaggcactatttatacctgttgtgctattgaggttagttgtgataaggattaatttgtactacaaaaggcctactcaattgttagttgagcaggccttttgtgggtattttgattagaggtattaaccctatgctaattataaggcttagctttcaaatggaacatactattatccaaattatgatttgttaaggtggtgttgtcatagggtacaaatttgtccaaaaattcggattaaatttgcaatctaccaattgaatagggccaaacctctttttcactcgcaaattgatgaaaaatctgattaatttgcaaattgcgttgaatatagagattcatgcgcggcggcacgacccagagtctagggtcattgggcaagtcacgtttgcgtgagacattggctttaagatgaaataactgcttagcctcgggtgaagtggctaagatgagcccaccattggtgtttttagcttcactaagaacgactagtgggacttttaaaggattaagcccgcgggcaacggcttcacaacttgcataaaaggacttgttatcaattaaaaagaacacgccatgcggttcttgatcaaaaaacataagctcaccttctcaataatttacagttattttaccacaaaagggaacatatgttcacgaaagcgatataataaatacataaaatgtatgggcaggtcgtcgagaacttgtatggaaaactgcatactcaagtgaaagctaatcgatttactccagcagagaagtgggttaaatttatcaaagaaaatgaggtccttgacggtatggaagagtccatgattgagttggagttttagggaaacacattgagattaaacgccaaagatacaaaagtaccatactactttagtactgtgaatattaattatgggtggaaaaaaagccactttttaaagtgacttttttaacaagtaacaagtaacaagtaacaagtaacaagtaacaagtaacaagtaacttgttacttgttactaagccctaaagcacttatcccagcttctagaatagtgtccaatacatctactttagtttttttctgtttatacgcaacttcatttatgagttcatacttgctctctttgactctaagaggttttgttttttcttctttagcaaatgggcttgttttactttccagcctttcttttgcatgaatctgattgagaagacttttcttttcaggcatttttatttctccattcgtgtcaatgcttcatctaaaactactttgtacatgtgcagtactcgcttgtcccaaaggtcattatttttaataccacttctaccaaatcttttaacgcgttctctttgatagatattttcatggaacaatgctgggccaagtgattctgaagcgtctttgataatttcttgatcaacgcgaccgtctatcttcacaagatattgaattatgccaagtaaatcgaagtgtgattcgtactcggtcaagtcttgaagatagctaataaattttaatgtactagaatatgcttgttcctgtgtttgcagtacacctataatgtaatccgaagctaaaacagcgttattgacaaagtttgataaagttggtggtatatcgattaaaacaaagtcataatcattctttatattacttagaagtttatcaagaaggtatttacgctcatcttttctatactcttctagcatatctgggaatgcggatagtgaccaatcactgactaacatatcaaagtagtcagtaaattttgtcacagactgagacaggtcaaataattttagtccattcataaattcatttttgggtttgctaatgatctttgggtatgttttcttcataatttcactagcgttaccttgaggatcaaaatctactaataatacttttcttttagtttcagctaataaataggaaaaaagacaactagttgtagtttttccaaccccacccttgaaattaccgattgttattactttagtcatgaagccacctctttcaataacctaaatataatacaaaaaggcgattttgtaaacatatttttgtaacaagttacttgtaacatgtaacaagtaacttgttacaaaaacagtgatatttcttttgtattaaggttgctttaatttgtaactatgttatatttaggttaacaaaaaagagcgtcgatcaaggagttatttccagtaactctctgatcagcaaaccaagtaccgggatacttgatcgcctttaacgctcgtctttatagatggcaagctaggatatgaactactaaaagtagtcaactctagttgcctgataggaatattatactaaacctattaggaatatgccagtcgaaaagtcgagttaaacgcatacataggtttagttaaagcagattaagttatcccagtgggcggcttaatctgctttttgtgtagttaagtctagagggagaagtgctccatgtttgttgaaacctgttaagctaatcccaattaaaaattaaataaacaaaaaatccccgtggggctaatcacgggaactcatagaactatcaacgaatgagttaattgtactcgtaccagttacgtttggcaagaatgcagtttgatgaatttgaccgccctaagagccaagttggggtttaaataccaagtagccacgttaactggagcgattgcttaaaaatctagtgtttgaacttttaattctaatacataaaaatgatgactgagaacgctacggcgttcttttttagtagggggtgagcacagtatgtcagcgatgaaaacagcacaacaagcgattgatttgattttgcatcaaggattacgggaaactaaagcccagcatagtaacgtcttgaagttagaaaaaacgattccggggaagcaaaataagcaaggtgcgattgccatgtatcgcagtaaagcccaaatgtcgaaaagctgggggacgatttatacctccaaagaagcagtctatgataactatactaacagcacgcattggacgcccaatgtttttaattatcttacctatacagatgcgactaagcattatgtaaaaggggctaaggaacaaaatttaagtcagatcaatacgttagtggttgacgttgactaccgtgatgttgaggagcgccaagcgaagtttgccgaggtttgggacacggcaatgttagacgtacagtttctcccaaccttaattttggcgactaccaagggctatcatatctattatgtctttgatgagccagtgttcgtccgtcgtcacgctaatggaaaattgccggcagtgcgtgcggctaaagcgattgctaagtcattaaagcaatactacgcgcaaaaattgccggcggttgatgtgacttgcaacagctttggtattttcagagtcccgcggccagacaatattgaatactttgagcctaaaatgacggttgacttccaagctttaatgacttggagtattaattttgcgaatgatcagcaccaaattaaggctcaaactattcaacggtcttttaaggctcggcggactagtcgccagattgaccaaccgtggtttcaagccttaattaaccaaacggacattgatcaaaacgtgggctatggtcggcacaatacaatcttcacgctggccttagcttgctattcctcaaatgtctcgcaagcccagtgttttgatattttggacgaatttaacagcaatcttaatcacccgctggcgacacagcacgttcaaaaagtaattaatgatgcttattcaggtcagtttcatgcggccagccgtgaatatgtgaatgcgttgctagaaatttgggttcccgatgctgacaggcgggtttatttgcagcgttcgcaaacgacctggtacaagtatgcgaagccgcgcacagaacgcgttaatagtcacgttcatgaatggcaagctgatctcatggcttactttaaccaaagaatttcccaggacaataattggtttaccaaaacatctttacggcacatttctaaaggattaaatatttgcttaggtagtctaaccaaagccctgaataaattgattgaccagggcttagtttatcgtgaaaaaggacatggtcgtcaagcaaccatgtttgcgacccggagtagcctattgcaacatgcgatgagtttacaacgccaacagcgattaaactattggctaacggtggctcggttattagaaccttcagaagaattagtggcgttacaacaactgagccttgatgctcgccaagaccatcaccgcaatgcccaattgagcttgctagatacgggttaaaatttagtgttctaaaatgccattacgtatctatagttctgtacacggttttcttggttggggattgagtaggtatggtgggctagactagggtgttatttaaattctagttgtcccgtcgcctccaaaccgttgagaaatcgccgcgttcggcaggcatactattcttaaccgatcttctcgacccaggcggtttttaagccggaaatttcggccaatactatttgatggtgagtagtgttgctcgcttttgatgagcagtagttaagctaactgtaaattgaaagtgagagggggttgattatgagaacgtgtttggatactttgacattcgatttgattttagttaaattagatcaaaaacaggagtttttaatccatgaaaagctttgcacaccattatag

SEQ ID NO: 24 - DNA, 10625 bp, synthetic construct
  source 1..10625: mol_type = other DNA; note = Lactobacillus plantarum PDG8 - contig 24
gtattatatggcttaacagaaatagcatcaatcggatttcttaataacaaaaattgggatcttggtactaaagtaattagtaacaccttagcaatagttaaatccctaatatatttactgctatacagaataatcatgattggttttgcaaagataaaaccagctaaaacagctattattgatacagcgaaataaagtagcatcaatacttttagttgctttttcacttctcctaaagatcgatctactaaagctttacttacagttggtagtaagattattccaatataactgaaaaacggaagaaatgattgtaatattcccgtagatgctgaaaatatccctgaagaatttttgccaaattcacgattcacaataactaatggtaataaataataagagaattgaattacatcaccaaagattcgaggcaacccataaatcaatagttctttgattcgcttcttaaaacttttgatttttttcaagattggaaattgatttaaaaaagaaaacaatcccaaaaaaggtatacttagcaaaatattagaaattccccaaaaaaataatattgtagctacgccatctaatctaaaaataaaaataacaatcatatctataatctgaattaaaatttgaattacagtatacaaatagtagtattctgctcctctatacgcagaaaaagaaaaagtattaaaacaagttccaatagcaaatataatcattggtagacttaaaaaactatatttagcactaccaaataacaaactagaaatactatttgaaaagataatacccaatataatagctaaccctgatgctattatcatcaataataatccggtttgataataatcgtatgctctttctctattgatatgtttattcatcgcaaaataccggggtacacttataccaagttctaataagacaataaagcccaatacagttgctgatcgtttcgcaatattaaaaacaccaaactgagaaactccaacataaattgcaaccattttatttattatgaaattagttaacaatacaataaattgaccagtaaatgtaatgaatgtatcttttaaaaaactactattctttatttttgttatcacgatatttatttctcacaatcattaaatatggtataaatagcactaatgaaatcatataactactatatgtccatggacttattaagaagctctgcataataaagaaataaacatttaataaaataaatgaatttatataaattccacgtttattttttaaatacaaaaatgatatacaccctaatgaaattaatactacaataaaaagtattgaaccaataatgctaaaatcttgaatacatcctctaaaaacggtataaatatttgaagaaaagttttcaacatacactggtgttgaatagacaccttgagcacgatttctgatgcctaaaaagttcataatacctaaaaaagtattagatccataatcaaacgttgtaatatttcgattattaaaccaataatcaaaaacgggtacattcccaaaagcatagactaagaatttagtccataattgttgcacaagcagtatcgaaaactcaccaacccgtaaaatcattgaggaaaataaaagtataactattccaactccaataaaaaaataacttaaaacattttttgtttttatacgtgtaaatgaattatctaatattttagcaataatcaaagaaaatatgaataaagttactgcagcaatccatccactttttgtattctgcgtactcatagtaaatagtgtaggcgtaagactgattagtccccatcgcttttccttcttttgatttgaggagcctgcatgataaccacctacaatgggtgctaaatactcaaacaccaataaaatttgtgctattcctccagtttgtgtagtgccagaatatctcataactgctacttgattattgacattcatcaaacttgaaaaatccaatatttgagaaatagagacaccttgactgtgcaaactaactacagcaaaagcgtctccaagtaatgtagtaataaataaaataactctgcttctttttacattaaaaataatattctttttcttaacacttatatttaacataaagaattttattggactagtaataacaaacgtcattaaacaagtaactagtatataaaacaatccactgtaactgtaattaaaatttaatacaactattcctatacctatcattaagcaccaaaatgtaacaaataacatagcgggttctatgaaatcactttttaaatatagtttattcactgccatacatactattagtaagactaaacatcctactgaaaataataatctctccgacataaataattacctcccaaattgcaagaacaaattagccacacgataaatcctattaaatcagtattttcattaatattcatattttatggacttaacttaaccggcgaaagcagcggagaaaagctctttgggtgtttgatagccagtttgccggcgcggtaaattgtttagctttgactcaactgcttggatatcatgaggacccaaaatatccatggatagacccttgggtacatcgcggcggatcattcgattatgcgcttcgttagtcccacgctcagaggaacgatatggatgggcataataaaggtcagcgacaccggtaagtacagcgccaacttccgagaactcagcgccattatcggcagtaactgacttcatgattgatccgtattcttgacagatcttggccagctcatagttgactgaatcggcatcacgaccatcgatcaaacgtagaatttggcagcgggattgacgctcgatcagcgttaagatcacactctcttgaccgttgcgcttgcccaccacggtgtccaattcgaaatggccgaactcttggcgctggtcgatacttttaggccgttcatcaatactccgtccggccagacgcttgtgcttgatcgagtgatgctgtttggcacggtggcgcgttttttcgagtagatcaagattgcggacttcaagtaactgggcatcaatatagtggtatagcgtcttggtcgagaccatctcctcaggttgatataagccttcaagtttggcccgtcctaccgctgcgtcaggcgaccaaccatcttgacgcaaatgagtcgtaaaatagtcgataaaatcagcgacaccgacgagtttcaaaggtcgatgacagtgggctcgattagcttcgtacttagcttgtgctgtttctggtgagtatgcagcgtaatattggcgttgaccattcactttttttacttggtcgatctcgccgcggcacaattcattattgattgtttgatgacaaacattaagcgctctggaaattgcacgattggaatagccttggctgtgtagcgtagcaattctgcctcgttcaaacgaagttaggtgctgacctttttttctgactgtggtattctgttcttgcatcaagacaataacctctttcattgtttgtgtaggaacatcaatgataacagagatttgtcttggtgttttttattttatcaattagctaaaagtatttggctaattgataaaataaaacgcgcgataaataattacctactaaataagaatatctttgctcgcagactgttgaaggatataattcccaaaacagaaattgatttgagtaaagaaagcttctcatactttctataaattagccaatgatatttgaatagcgacatttttttcgatgaaagtgactctgcgcgtaatcgatgaaaagtcaacacctcaggtatacatataattctttgggcctttttaatgacagtcaaccacattaaataatcatttcgtttacgtatattaggaatatacgttttgccaagtacttctttattatatataactgttgaatttccaatattatgaagcaacaagcgattataagtaactattctttttgcttttaccgtataatgtaaattatttccatcctcatcaattttaccatagtatgagcatgtaaatgattgattatttgttttcataaaattaatctgtcttgttagtttatcgggtacccatatatcatcactatctaagaaagccagaaacttcccatttgattctttgacggctctgtttctagccatagcagcaccttgatttttattctgtttaaataacttaatgcgtgaatcttgactagcaactttactaactaattctgcggagttatcagtagacaaatcatcgactactattaattcccaattacaatatgtttgtgcctgaatgcatttaattgtattaccaatatagtttgaagcattatataaaggcataataatacttacaagatcctctttagacatagaaactcactttctcacttattgtattcatctagctccatccccggtcactacaacacgaatcgtttcaaagaaaatcccaacatcagtcaataccccaaaatgctctatgtagtacatatcattagcaagcttttgtgctggtgtatcgtcgtaaccaccgtgaacttgagcataaccacttagaccgggtttaactaatagacgttgctcaaaaccatcaatatcttcgctgaattgttgtgtaaacattggtcgttctggtcgcggaccgatcaaactcatatcacccttgatcactgaccataattgtggcaattcatccacccgtgttttacgcataaaatgaccaacccgcgttacgcgtgggtcttctttctttgcccacattgcaccagattttttctctgcatcactatacattgatcgtaatttagttactttaaacgattggcccattagcccaacacgctcttgactatagaagcacttgcctggtgtttctaacttaactaaaatcataaaaatcagaataataattgaagctggaatcatcaatagcgttgcgaagattagatcgaataaacgcttaaatggtaaatagatgtgatgaaacggtcgatctaatttagctacaaaatcatattcatctactgtttgtgtatgactgatttggtttcccatgataagattccccttaatccgttaacgattcccaatataactttaacccagtcgtaatatcataatgcggctgatagcctaaacgtcttaattgtgtaatatctgcatatgaatgtttgatatcccctacccgttctgctttatgaataatttgtagctcccgattaataatttgttcatacacctgaattacttgattaagactagtatgtttaccgacaccaacattaaaaacttgatgtacgatgttgctacccttcgtcaatacgcataatgcttaagttgtggcctggctagttctattaattataaaatttgttagtaaacaatcaaaaatcattgtgaagtgaacctaatttattttgtttgaacagcattcagattaattttacaatctaacttaattcatctttttcagatttatcaatacgcattgcgaacatagttttttcattttgaacaacactcattattttatctcctctaaaatcaattgctatccaacacaaacataattatatttcatatatatcctttagtgtccgaaccgttttctataacccttacgcagcttttcaacattgctagtcccgataaaaactcttagaaattttcgaatcttagcctttacaaatatcaatctatatttaattctctttttaatcccctggatgtaagctgattccttaaaaacactttctgggctacttcattgaaacttattgggacttttcttcttccaataagtctttgaggactatcactaaattcagcaatctgacttccaacgaccgcaatatcctggtttttatcctcattcatataattaagcataacttccatacgttcaggattatttaaatcgtccgaatcgaaacgtccgatatactcgtaactacatgctctaagtccctctgcaagtgagattcctaaaccacagttcactggatttttcacgaaaactattttaatattccgattactacattcggatttaaaccacttcaccacttccgtcaagtttaggccaattggtccatccaatacacacacaaactcttttggaagaattgtctgagctaatatactatcaaaagcgtttcgtaataaatcaggactttccttactataaattgacatcagtcctgaataatcttctaccattaacgcgcaccatccccagtaaacacaactttgactgttcctaataacatcttaatatcgaaccaaaccgaaaaatgttcaatatagtaattatccagcttacatttatcgtctggcgtaatatcgtagccaccattaatttgtgcataccctgtaataccaggaataatacgtaaccgtttagggaaatctgaaaattgccgactaaactcctctgtcagcactggccgttctggtcgcggtcctaccaaactcatatcaccttttaaaacattccaaaattgtggtagttcgtctacccgagttttccgcatgaaccgcccgattggcgtaatccgtggatcatttttttgagcccaaaccgcacccgttcgcgcttcggcatcctgatacatcgaccgcagcttaattacattgaaactcttccccatgaggccaacccgttcttgcttataaaatgctggtcctttagaagtcagctttacaagaatggcaaacaccagaacaattggcgaactcaaaatcgtcccgattaacccaacagtaaggtcaaaaattcgttttacaaatagtttccagcccgtaactggctttccaatcatagttggaaaacgataatccgtttttggttgtacatgaccaactttaactgtttcattaatttcgacttgcttcacgttgttgcgccccttcccaatatttgctcaagcccgcttctaacgaccacttcgtcgtgtatcccaacttaattaacttaccgatgttggccaccgaacgttttacttccccttcacgccctggcgcctttttaatctgcaatgacgttcctgcaaccttctcatatgtttcaataatggcatttaagctggcttcattaccattggcgatattaaagacttcatgctcagtatcacttttcgttatcaaccataacgcttggataacatcttcaacatacacaaaatctcgtgtctgactcccatctccgtacaaggtaaatggcttcttgttattgagacaatcggtcaagatcgacagcacccctgaatatggcgaactgggattttgaccagggccataaacattgaagaaacgcacacagacagttggtaaatcataaagttcaccatatgctagtacaaaacgttccgtagcatacttatcaatcgcatatggtgataatggatcaactcgtgagtcttctttcttaggtaattctggaagattaccgtaaacagctgccgaagacgtaaataggaactgtttaattggtaaattagtcttccgaatatattccaacatattgaatactgcagtttgattcactgaatgggtttcagctggacgttcaatcgaatcggcaacactagcaacagctgctaaaaagtaaatataatcaggctgttcttcctgtagcaattgttgcatgaatttttcgttgcggacatcttcaacataaatagtgacttcatcctgatgcttaacattatgtaagtcccccatggacaagttatcaactacgacaacgtccaatccttctgcaaccaagtggtccacaaggtgggaaccaataaatcctgctcctccagttaccaatgctttcatttaactcgctccttcttctagaacaaccagtgctttcgctgttttcgtggtatttcaattccgccaatatcaatctgttcaccattcaacaaatcccgagcgttggttgcaaaacgttcaggatatttcgaattcatttcatttaatacttcgtaggccttagtcatagcaaagccccgatttttcagcgtatgcgcatctgacgcgaccacttgaaccaaaccacacttaacgaattcttttgcagttcgctgtacttgttccccaaaagcgccaactaaactcgtggccgtaacctgtgccaagaccccatcctcggccaacttgtataatcgctgcggttcggcaataatttgagcattccgttcagggtgtgcaatgaccggggtaatcccctcacaagacaattgaaaaatcatttcatccaaataacttggtaccatctcgtgaggaagttccaacagtaaatagtgtctactggcatctatgcccaacaaatcatcaacattttccatcaactgaccatttagatgtacctcttgaccaggaaaaatggttaacggaatatcatttgcatctagctctgcttgaaataccttaaccgccgcagacacatcacctgcatgattgagatagtgtcgatccatatgatgtggtgtcgctaaaatatagcgaatcccgtcagcaaccgcctgccgtgctaattccaatgacgcttctaaggaaggcgaaccatcatcaatggctggtaagatgtggcaatgtaagtcaactaaattatttaccttcatcgctgtagtacccataaccgctactatagccgtaatagccatggtgcgaaccatcgcgaacatcattcagtactgcgcccagaatattggcttgagattttttcaacgaattaacagcatcacgaaccgctgctttttgggctacaccttggcgaacaactaagaccgtgccatcaactttattagcaagcaattgtgagtcagtcaccggcaaaattggtggtgcgtcaacgatcaccaaatctaatttacgtgttgccgaagttaagaattctgtcattttgttgtttcctaacagttccgcgggattcggtggcttaggaccactcgtcatcacaaataagttatcaataacgggatgaattgcatcattcacattgtccatttgactagccaaccatgaacttaatcccttatgattttcaagcccgaacgtcatgtgaatcgttggtcgccgtaaatcagcatcgaccaataaaacttgcatcccttccttagcatattccaccgccaagttacaacttactgttgacttaccttcaccaatcatcgatgaagtcaccattaaagttcgtaaatttttgtcagtagccgcaaaattgatattggttcgaattgttttaatctgctcagtaatgaccgacgtgggttcattaatcgtcgtgagattaattggtgccgcagtcgttatattctgttctttacgtttaaacatctaacaccctcctaaactcgtttcatcgcttgtgacgatgttcgatcattatgcgtatgatagccaccattgagatttgaagcttgcttcttcattgaatggtggtgttgatgattaaccaagcctaaactcgtcaaacctagatcatcagtcaaaaattccacatcatgcactcggcgatccgtcaacatccgaattgcagcataaaaaaaacctaatagtaagcctgcgactagtcctattaacatgtttagtagtttctttggtgaaattgcactattaggtgcctcagccggtgcaacaatcgttacattgttaaccttaataattttctgaacttggttcttaaaactacgcgcaatttgattggcaattgtcgcactagcttttgcgctagcatcagtcacggcaattgagaaaacctgtgagttggtcgtgcttgtcacactcacttcacttctcaatgtgttcagtgagcgctcaatgccatagtgtttacttaattgttgctgagttggttttaaaaccacttgtccagcaattaattccttgtaggtcgtaatcatctgaacgtcagcctgctgcccagcatactcagtagcggcattagtatttttacggttaaccaaaatctggacacttgattggtacttaggtgtaattacaaagaaggtcagtcctgcggcaactatcaatcccaccaccgtaaaactgacaattgcacgccagtactcacggacaagccggataaaaaagtcaaaacttactgtttgatccataattcactctccaaaattttaacaagattaaaacacgttttaactaacgctattaaatacaatctatcatcaaatataacaccgcattggttgatttacaattgaagtccaagaagcgatctcacctattgactgcaattcaagatttttcatttaccttttgatagagggttccatgatagtctctatcatgttttttatcggccaaatggtcaatcaattttaagaatattatggtgatcatccaacataacccttatatggtaacttttaagacgctttgaatctgtttttgaaacatatgtgtgatgcctctgtggattcctgttccttagccttttttgctgctattatgagatttctcggtcctggttggattaaacttgtaatttggtagattgtaaaattaatccgaacgctgttcggacaaaaaagatcagcttcctttaaaatggtgtttaccacaaacccatcttttaggagctgatct

SEQ ID NO: 25 - DNA, 9771 bp, synthetic construct
  source 1..9771: mol_type = other DNA; note = Lactobacillus plantarum PDG8 - contig 25
cgcctctggcgcaattgtgagcgaaagctgaacaccagtaagatgatgattagcttagccttcctgcgaatactcttgaaaagattctaaacacgttcttaagactggtttagagctgtcaattccttatgctcccacgctttgctcgtccgctaccattgacagcaaacagttagctcttctaaaacataataagaatttaactgctatgtcccttttaaggcctttattttcaattctcagcagttttaagcatatttacatataatttatgccaaaacaaaataaaaagccctcagtgagcttttagagggctaaattacaaatcctggtcgattaataatatcttcttgtcttttttgcaaaatgtaagtgtacaaggaattatacaaattctgtttgatctcatcaggttcatgaacaaaagcttcaaacaattcttgaatatcaacttgccaaggatcagcaagcatttcatcaattggctttaatacttttttttcgtccatctgagttactcctaacattagctaattatttcaggtttaaattaaaggcatctttttatagttagttattcaaagatggtaattaagtttagaaagaaaaacggtgtaaagcaattaaaaagatttgtttgagcgcagcgaaatctaatacaactttttttagtataagcacaatcaactttagttgttgtgtgtaagtgcgcattgaactaaaaaacaacctttatttcaatgatcaagttagctattttttagcgtcattaaacggaatgaaatgagtttaatgcgcacttacacatagaatttattctatgttgtgctagacccattaaaaacctgtatcagaagtcgccgttggcgacaacaaaatcaaaccaatttacccaaaatcaatttggttcaacatgttttctgtacttgcttgattcaagcctaaataagctaaagtcatggcttcacttgagtgatttagtaagtgcatgactaggccaatattgtaatttgattgcgtgtaaacacgataagccccagttttgcgcatcgtatgagtacctagataattaattcctaacagatcgccaaccctactcataattttgtagaactgtttttcagtgatatggcgatctgggtgttgaatggaaggaaagagccattcagatgctagtttatgatcaagcagccattgacgatacaataagagttctgtttgaactggtttaaggtacaaggtattaggcttaccagtttttcgatcatgaatgaacgcattttgtttaatagaaccgtccagattaaaaatatcggtctgttttaaacccataacgtcactcactcgcagtagcgtcgctttaccaacttgaaaaatcgtatagttacgtcggccagcttaagaagctgtttagtatctttgattttgaccaaataatttgataaactactgtcaaaaaagttggtaatcatatgcaacattttattcatcattaccaaagcgatatttctcggcaacaattcgatttgatccgccaggatctggaagcttcaagaaaacgaactcacccaaaacacattgatccttatgatatcttctgtgccatgctctatgtccttaaaaatggttgtacttggcggttcatggaaatcaggacatgaaaaataaggaggtgtcatctaatgagcttttttaaaaacaacacaaaacgaatacctactgaagtgaaattacttactgatatacaaaatgctttagctgatgcaccaactactgaagaaaaaccatttttactggaagcagaacaatctttaaaagacaaaaaatatttgccaaaaattttaagtgatttacaattttttttaacgcccctagcgataaaatctgccctatccccaaaagttaaagttatctatttgaatcttatctcagataaatatcaaactagtacaacgggtagtggtattggaatgatttttggtggttttagtggatttggtggtcgctagaaagaccataccactaattagagatattaaattacgttttagccacatcatcgttttaactgatattttgattttctgatttatcttactgttagtgctatagcatgatttgatgtagtatgcttgatttcaaaataacgacagttagaacaatagaaagggccagatcagctattaacgctatttaattctgcctgagggtgtgaccgaagtttcctaaccgtgggcttgattttagcaacgaccaacgggaggcgcagttaaatgtgagcgtgggcttcgctcactcctttttttatcaaattatttggtcaaaatcaaagatactaaacagcttcttaaagttattgagtaacgtatcttgaacctctttaagaacgtttgaatctttgatgggtaagacaacttgttgcataagctgttagttcctttactttaaaattaatttagttgcagaaaacctaaaaatcgaatattatgatgtagtacgatggtaaacttgaaggaggcggattagaatgagtaatactattattaaaaacaagacaatttcaactcgtgtaacacctgacattagtgaacgggctaaagctaatctagcaaaacaagggctaaccgtttctgagtatatacgcttatcgttagttaaagcggccaataatgaagttcgattagtcagctttttagattctccggaagccttagccgctaaaaaagaagcagaaacagggcaggtcaaaaacattggttcattgactgactttgaagattggatcgataagttagatgcaaattaaacagactaaatcttttgaacgtgaattaaaaaaactagtcaaaaaacatttcccaataactgtcttgaagccttgtttagaagcaattgttgaacaagatgtacttgttttgaatcagattaaagatcatgcattaaaaggaaattggcgtggttatcgtgaatttcaccctgccagatatggaaactatggcaaaaattatgacaactggattgttatttatcagctagatcatgatgaattgattttgttattggttgcaactggctcccatgaaatcttgaatcaatagctataggttaggggtacttataaaaaaataaatcaaaatagcccccaatatctaaattatagatattgggggctattctttcaatgtttttgaggggttatttgttaaaaatgggcccttaaaaatatatagcttacttgatcttcccattttcctggaagatcttttttgttcgaaaataatccgacaaaaatttgttttcttgtttttctgtgctaaaattaagccgtctactcgaacgtgtgttcgaatattgagcaaataatttttaaggaggttgaatcagaaactgcttactcatttgatagcttgttcgttgtaggcgcttatggttgctaaacaacacagaaaggacgatttatgtatggatgaaatggtaaaagaaacacaagtctggctcaacaaaacttacggtaaagtttctggctttggtaaagtacccgaggacggtaatactggttggaacacagtttatgggttaactagagccctgcaacacgaattaggtatcacagatctagttgataattttggcccttcaactgccgctaaatgggatactcaatttgctaataaagttaaaactggctttaagcacaatgttgttaaaataatccaaggtggcttttggtgtaagggtatcaaccctgaagactttaccggagaatttactactaacacggctgctgctgtcgttgaattaaaaaaagacgccggtatcaaagacaccagcgccaatgtaaactcggatattatgaaagccttgttgacaatgagcgcgtttgttttagttcctggtggggacgctaaaatccgttcaatgcaacaacagcttaatcatgattatcaagcttacactggtattttaccatgtgatggaatttatcaaagggatacgaacactgctttgatttatgctttgcagtcagtggaaggtatggatactggaactgctaatggttattatggtcctggtacgatcaataaaacaccaactgttaattctggcgcaactggggcaatcgttaaaattattcaatatggtctttacgttaatggtttctattcaggcgccttcaatggccaatttacacaaaatgttgccgacggtatagtttcctttagaaaattcatgaagttgcctccttatacttcaactgctgacctaactgtgatcaaaggcttattaactagtaatggtaacactaaccgatcttcagatggtgtcgacatggctactcaaatcacatcagctgctacggctaaatcactgaaagcagctggctataacattatcggccgttatttgacaggaagcgtcgggactggtgctgataaacgagataaaaatttgactaacactgaagttaaactgctattagatgctaaccttaagatttttccgatttacgaagatggaggttatgaagaaagttattttaatagcaagcaaggtttcgcagacgcttctattgccgttaatactgcacgtcagcttggcctaccaagtgggacagttatctattttgccgttgatgttgatattcaagatggaaacatgagtagtacggttgtcccctatttcgagggtattactggtattataggatcaactgaatataaagcaggtatttatggaacacgcaatgcgtgcttgcatgtaaaccacttagttaagtatagttttgttgctgatatgtcttctggatggagcggaaatttagggttcaaaatgcctgaaaattggagctttgatcaattcaatgaatttactggagcttcaacagggattgatatggatcaagttgctgtctctggtaaagataacggagtttctaaagttaccaaagttaatataaatcctaacgctgctttctttacccaactgcaacaagtagaagaccaggcatatagttatatcagcggtgaaagctcttcaacacctgctgaacaacttgttacccaattttatagacaattttcctattcttcaccaagttgggcacccttggccggtggattaaatactagctggttagcattcgcaaactcagcattacatgtttcaaaagaaagtgacttcgaaactctttatgatagtactactggcataaaaattggcttaccacacatgatggcttctttaaacgcacttttattttggggagaaccacagtcagcctcaggaattcaggaccttgggggctggtgtggagatcttttaacaagtatagaagatgctcatcttaaccagaaaaaatacggctctttttatgaatcaattactgcatatgtaggtaataaagggcaatttggaagggaagatttggttgacgatttggatgcacttaacgtttacagtacaatccattcgcaaaacaaccaaactatatccaaaattattaaaacttattacaccggtaatgaaagctccgttcgctttaattcttacctaagtaatcgttttgatgatgaccttgattcactacagaacgacacatatactcttttaaaaggtggtacaggttcatggggtgcagcttataaaaccgctttattggcttttaaaaagtttaaattacaaaaatatccttcttatactgacagtgaagcaaaagacgccgctaaagcttttcgcaagttaattgaacaaaacgcatagaaagtaataagcaaaatgataaactatatatattagtttatcattttacttattttagttttttacttttatctaaaaaatagaaagaggtgctaaatcagccttgtactcatggttaatcgtaatattagttgttttttttctcataacaattgattttttatatttatgtgaccatataaatgatactatcattgaaaatggctattttaaaaacattcttacaattattatttcaattttatctagttggttcatctccaaatatttgggccctttttttctaaatttcacttcagaagttggagttaccaattcattcggctttatattaataattgttgcattaataggcttttcactcctattcaacgctgcaaggcatgacattgtaactaggaaaaaaactgtacagcaggctcaaaaaaaatacttcagacacaatcaagtcctaactttttctatggttcattacgtaatcggaataagtagtgttgtaatagttaatagcattgtatatttaccaatcttcctcgactttttaattccgattcccaaaagttaccctggtaacgttgaaaaaattgaactccaagaattcattacttttattattactcttgtaatgccttttttaatcatagtttttacccccttttctttgaaaaaattactctcccatttcaataaatagggtccattatctagtatagaccctatatcttcatagcccctttctgtttggtgttaaagtattagtcatcgatgtcatgcactatcttgtttagctccgttttgatggaactggaaatattttctagattgaaatgattatatatttctttatccttaagcatccttttttgtgccttatttaatttacactcattgttacccactacccattcatcctttgtacgtataaaggggttttgcgcactttcctttaacgcgttttgaacatcttcataaggtaaataaaattcaattgtagatttatttaattttacaatctaccatataacgtctccatcttttcaaaacgacttaattctacgggctataaataacttaatttgccagtgtataacgtttcagattaagctaccactaagttataataaccatatcgaaaggagatcaatctaatgaaatatacgaaaaccaaagcagtattaaatcaactcgttgccgatttgagccagatgtcaatgattatccatcagacgcattggtacatgcgtggacccaactttttgaagttgcaccctttgatggatgagttcatggaagaaattgacagccaactcgatgtcatttctgaacggctgattgcgcttgatggcagtccttactcgaccttaaaagaaatggtcgaaaacactaagattcaagactggcctggtgaatgggacaaaacaaccccagaacgcctcgcacacctagttgatggctatcgttacttggaagacctttaccaacacggcattgaagtatccgatgttgaaaaagacttcagtacccaagatattttcattggtctcaaaaccgcaattgagaagaaaatctggatgattcaggcagagcttgggtcggcgccggaaattgatgaataaaataatattaaaaaatcggtagacttatggtagattttaaaattaatccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctacccaccagaataatctgtgggacagtcccagccctcaccctttagcttggcagctacagattgttcaaatttatcttccgctatttaactagtcttcttttcttttttagttgtaactatttaccaaaacgccaccactttttaggtttaggttgtgactccggggtgctattttcaggttccggttgtttgtctgacgtcacttctttttcactattatcatgcggtgccatcgttaaggctttcaagtccttaatttctgccttgtattcttcgagcagttgtttgtcctgtaaggccaatctttgttgctgatctagtaacttatgtaactctttcttttcagattgaaattctgatactaaatttcgaaggaatttcacttcatcttgtccatcaaccgcatcttttttgttgtcgtcaacatcatctttttgttgacggtatcttgttgatgaatcgtttgagaacattgctttaatagctttttgcccatcaacatcaacgtaaacagtattgccttttgttgatgtaaattgacgtaaatcgattgacgcatctctttttatcttttgccatatagcctgctttgaaacgcccaattcatcagcaagttctctaatagttttaggcatgatttccaaacccctttcggagttcagcaagtgcttcttgtcttgcttgatctcttatttttttatcgtgctcggcctgtttatcagccaatgcttgtttctcagtagagcctaaagttaaccccttaaccttgtcaatggcgcgccatttttcctgctctgttaattcaccattatgctgaatattaaaaagcttttgacgctcatcttgtaattggccttgtgagaaatcattggcatctttcttttctggtttccaggtaaacgaatagccaataactggtttcccacgccctttaccatatttttttctaaccgttaatcctctaaacaaaggagttaattcttctttaatgggttttataacaaatttatcgacgttagagggactattccagtaacttttgggcatatctagtaattcaaaaaagtcttctttagaaaaataagcatatccagtggttctgaactgttttagtaaccgaaacattgtttttgcgtaactactttttaaatctctaaactctgccaacgcataacgaacccaactttcaagcttgtttaaaaggggtaaagcacgttcataaacttttacgtctacataaggttcttctgcatctccatcaattttaaattctgtaaacaaaacaaaaaactctcgagttaatccacttttacttcgtctaccaaaatgtaatcccatcattttttcataagttctctgaatgtcatcttcaaaacggttatttgcagtaggtttataagcacttagctcttttaattgatcaaaagtaaaacgaatggtctgatcactcttatcacgcatacgagaaataatcgaaaaaaataaattcatttcaactggagtaaattttcgaagtggaatggtatttaactctggatcatatttaataatttcatttcccatgctgtacctcctaatgattacaaattaattttagattatgtttatcaagtagtcaactttatagttctacttgataaacagacaaaacctacttgataaacagacaaaacctacttgataaacagacaaaacctacttgataaacagacaaaacctacttgataaacttctataagccttgggagagtaaggttcaagaggggtctaaaagaggtttaaaagaggtttataaaagaggtatataagaggcactactgtacgagatcaagacctaaaatcaaaaacacaaaggagtgagccaaaaaccggctcacattaaactccattcgctacgctctttgcgcctcacttcgttcgttgcctaaaaaggtgtggcaagccacatttatacgggcgctgacgccccgcaccccgtcaagctgaaacagcttgaccgttttttcactcgccgttaggcaggaaagcaaagttttatagaaactttggctttcgccaattcagtgttagaacgtgtttggatactttgacattcgatttgattttagttaaattagatcaaaaacaggagtttttaatccatgaaaagctttgcacaccattatag

SEQ ID NO: 26 - DNA, 8292 bp, synthetic construct
  source 1..8292: mol_type = other DNA; note = Lactobacillus plantarum PDG8 - contig 26
acatggcgtttaattaactgatcacgtgcaattgcatattctaacgaaccttctttcgcttttaatgctctttctagccagtccattttttcttgtgaaacgatggctactgcgcgactatttgaacgagcaatataaacggtttcgtcttcgtcattaacttgatctaaatatttttttaggttggcgcgaaaatcgctctgtgttaatgctaatgtcatatttaccaccctttcattgtacttaatattgtactttaatttgtactaaaaatcaattttttaaggagctaaaactatgcaacaaattgtcttacccatcaaagattcaaatgttctcaaagaagtgcaagatacgttactccataatttcaaagctggttggcgtaactataccgtttttcaagtgggtaaagcgactctgttgcgagtgagcgacgttatgaagcttcgttggacagatgtctttaacgaaaacggcaccgtgcgtcagaatgcgtttatccacgaccaaaagaccggtaaagctaacctgctctacttaaaacccgtgcaaactgatttattagcctatcaagcttggttgcaagaaaaccatttggtttctgactggttgtttccctcgattcagcacccagaacgacatatcacggaaaaacagttctacaaaatcatgagcaaggttggcgatctgttaggaattaattatctagggacccatacgatgcgtaaaaccggggcttatcgcgtttacacgcaatcaaattataatattggcttagtcatgaatttgctaaatcattccagtgaagcaatgactttagcttatttaggcttagaccaggctagtactgaaacgatgctggataaaattgattttggttaggaggctggctttatggatttagattttaaatcaaacaagtatgatcttttcgatgattggcatcaaaacaagactaaacaagagtttacacaaaagttgcagcaacaagctcaacttgaaaaaacacagctgccacagttattgtcgcgtgaagatttaaaaattcgctggcagatgaactctcgtcaaagtgttcatcaagttgctagtaagcctgattttccgcaacccgtttttgcttttaatcatggtaagacgccactttacttagcaactgaaattcaaattttcgaaattaatcacccttgggtaataactcccagtgttcgtcttgcttatagtcattggatccttcgtaatgtgattgattaatcttgagatttagctctaggatttttatcgttggcgctagccttctaatacaaataatccccatcaaaatggggattaaatctacccttgacacttgtcaagggtgtaagtgcgcattgacctcgttttactcggtctgctgataaccatagaatcgattttttccgttgttgaatggaatgtattcttaattcaatttatgcttacacttaactgagtttgttatgctttaaatacttaaaaagtgttgcagattacgctgttttaagccaaaattttttaattgctttgtgcagagaatttttataagcttggtaacaaattttgaataacggtgttgtaagatttgtaaatctaaactgaaatcattattttgatgttaggagtaattaagatggacgaaaagaaagtattaaaaccaattgatgaaatgcttgctgatccttggcaagttgatattcaagaattgtttgaagcttctgtcaatgaacctgacgagatcaaaaagaatttgtatgattccctgtatacttatgttttgcagaaaagacaagaagatattattaatcgtcctggcttcgttatttagccctctaaaagcctgctgagggctttttatttttgctttggtataaatatatataaacagtctcaaaatctctagaaacgagaaataaggcccttaaaaacgaatatagcagttagattcttgttaagattcaaaaaaactaactgtttgctgtcaatggtagcggacgagcaaaacgtgggaacataaggaattgacagcttttaactagtttttacaccttttagcgtataaagttgcttaggttgcttgttagcacacaaaaaggcctatcaaattaatgacgggcctttttgattttgctagaatcgtcacactattatgaagtaggtgtttgtgtcatgtcggagacacaagcatgattatagcactatgcaaacttggtgcaatactaaaaaagtgaacacccgggtaagtgctcactaagaagttgtcacttcgaaacggaatcccatgagtcccgactaatgggacaactttattttagatcattctaattaaattgcaatattaaaaagcgactatctaaacagatagccgctcccccaagtaatatagatagcacacattattataataatattaaaattgacataataaaaaggtctatccagttaagaacaggcctttttactatacttttagagagaattaatctgcgtcaactcagatcaattacacccagttcaaaatgaaagaagtgtctcatgcctgaacacaagcatagtataacatggtaaaaatttgttgcaatactaaaaaggtctatccaattaagggtaggcctttttattgtgcagttaagttactgaaagtagtgtgtaatgccatgtcatgcagtacaagcacagtatagcatggtcagaaatagacgcaaccactcaatttctactagttaacataatccccattaataaaagctaaagtttgtgaagtgttaaaaacgttgttatatcaacaatataaggctatatatttaccaatatcatgcgataatgacgtttcatgtataattgtccgaaacatgtcggcttagaacccgcctaggctgagactatataatattaatagtgtgtctatcgttagtagttagttcttaacgttttgtggtctacgtgacgattagtacattaataacaccctagtttaacctatctgcacgcaaccacgtgctcttaaccctcaagttcaaaccagtttagtgcacttgccctttgctgttcagaacgcttgaacctgagcgggatatagttttccccttgttttgcgaagaagaaaactttttgttgttcgtcacgaatcaccgtcacgtaaaaacacttgtattgttactattgcgcttgtagattagcctaactaatttagcctataaaaaaagcaccctttataggtgccagcaatcatttatttttagttgtttggatcactggccttgcgtaatagccctgtactttcgtactgctttaccgcccgccccgtgcgtggggccaccgttcggaaccaacctaaatacaagtataggttaattcctagtgggggtttatagcggcggctctcacttgacctgtcgacttgtttcattagctccgctaaccggctgtcagtcctcgaaaggtaagattagttggcttgactagaatgttgccactctagtaacggggcttggctcccccgtgatccagaaaaattcaactctacctacttgaaaaatcttacaatagtaggtaaaatgaacacataaactttgataagggttatgtgttcccccggtggcgaccgagggaatttttttgtctatttaatttagttacaaacagtattatacccctttgccgataatatgacaaaggggtatttttaacgtctcagccagccgaataagccctttttaggcgtcttcacttcttcccccttataattaccctcggtaggctctgaaacgtctgtatcgtcgcttttaaggggactatcgtcctgtgagggggtgttggtatcaagtagcttttcattttgacggttagtagacaaattgagttgttgttgctgacttagtaattgctgaaacttgtctatctgattatttttagccttaatctctgctttagcgtcttctaagtcttcacgtaattgcttcactagatcactttcattgtcgatcttaggactacttgaactattataatagctttctatagcctctacggactctttagtgaaattatacttgcccttaacatctttcttaggttgcttatcagccggtatttctttgattatctgataaatacgaccgtttgtgacatttaatcgtttagcaataattgatatagtctccattaacattacactcctataatcaacaattataagcctatatctaactaaataatcatagtaaaaggctatgtatagtatattatagtgaactatgcactaaagcaagtcaacaagggcttagaatacgtctctcaacatatgatataattctatcgtgtagagttttaagggtagtggctgtttttgcttgaaaggtggtggtgcatatgcaatacactgcacccatactaggaagggttttcagccatattagcttggtgctggtttggtctagcagtcgcaagacttacttaccaaatttatcaatccacctatcttgttttattaattatggcacaactgttcagaaatttatgtaccaaatactaggataggagcagacaactaaagcctgcaaaatttgactttgataaatataatgatgaagctatgcatgagttttacgaacgtgttgtaaattaataactataatgtgttgcttcaattcattttctgaaaggtttgtggttcgaattatgtttaaaaatgtaaggaaaaataaaaggaatatttgggaattattcggcattatagtaagtttcggattaatcacgatccttttttcgtattccttatggagcacaaaaaaatatcctgttattattagttctgactttttctttcacatgaataggttgaagagctttttggtttcagttcaacatcaacagtattttccaaggattgcagtaacttttttgaattataacggctatgcttcacctatgttttatagcaatttaatattttatccgttaattttttgggctaagttcagcttttcgtacttaactttgtacaagatactgataatgattaccactttttcggggctagttatcacgtatgtgtgtgcgtggacttttaccaaaaaacaactacttgcatacttaattgcaattttatacatgacatcgattttttatcaatatgagttactggtgagaaatgcgttaggtgaaggggttgctatgatctttttgccaatagttttattgggtatgtatcgattagtgaatgcaagtaatcatggatggttatgtttgtgtctaggaatgacattgcttgtttatacgcacttaatcactacggtaatgtgtggcataatgttacttttttatttgatttttaatgtgaaaaaagttcttcaaaataaattaattttagtaaatctaattaaagctagcgttgtgagctttttgttatcagcaacatttcttttgcccatgcttgaacaacttaagcgagtgccaatgttcatcaatgcatcagaaattggaaatattaatcattttattaagtcaccttttgatctgttttcaggtacgtttgcaaattctcttgaatcgacaaatttgggtattatttttacgttagtcgtgggaattagaattattatgtgccataagcaaaaatggcttatatatggtgatcgttttatcatattgggaataattattgctatcagctctacaaatgttttgccttgggagcaattacttgattatacgaaacttgcatttttacaatacccattgagattaaatgtatttgcaacgttactgttagcaattggaagcgggatgtatatatacggtgaacttcaatgctataaaagtaaggggagacgattagagatatataaaatactggctatagtactcatcttatttatggatttttcagtaattttttcaatcacgtcaccaactagaaaatcatatgaaaaatttgttaatagtcaaacagctattgattcaatgcaaattggaaatggtaaggaatatttaccggttggtaccaaacagcaatttttgtcaaacgatgtgaaagcattacgtggtcggacgacaagagttagtagaaagttgaatgagtttaaaataagataccaattatcaaaaacttcaaatgaaggtaagctggttgtgccattattgatgtatccagggtatgcagcgactgaaaacaagcatgaattaaagataagacaaactaagaatcatcaaatttgtgtttatccaaaacgctcaggaataattcacatttggtatagaggaacggatgttcaaaaatatgcaagcttagtgtcaatttcaacattaataattttagttatttttcaatttttttcctttataaggagacaagcacatctcaaaacaacctaatttgaaatctggattagtatttgaaagttatttttattcggtaagaacatttaaaatgggttgcgtgtttgtgtccaaaaggcacttgatatttgtatagtacttagtgttaactaaaaaagctcgagagtaatctctcaagctttttttcgatgataaaatcattttttgtcgctgtttatttagtataggctgagtttacgtatcctagccaagcatcaccagagtagattgaataaaaacgtttgccgttaccaagcgtataatatctcttagccattagggtttgattaagataatcatttgtggaatgttccttagttttccacaataagtctccccagaaccattggttcttaatgacaatagtgacatttttattgtatgaaacaggtactaagtcccttgagccactcttattaatatatccagcccatttgccgttcttatcataaagtgacaagtaagaacttccgtttggattattgtaaatatattttgcagaatagtcatttccgatggtggctttgtctgcttttctagaagtaaatgtcagattaccccacaaaatatcttgtttcgtgattgtcacatttttcccatacttatgagctttaggacttcctaaccagtaattaatataatccatcttaagagaagtaatacgcgtcccaaaattagttacactattttcgtaagaattaatgccggtaatttgattactggcatttaatagtccagaaccactagcaccacccgtcatatcaattgtgtaaaaaattcggtcggtagttagtgcttggacagtgccactggctgatgacatattagggtatttgtcgtgtgagaaacctgttaatgtaagattttcaccttgagatacactggtagtaactccaaatgctcctatgtcaataaatggcacatctttttctaaacactcgttctaattctgtcggaattaaaccaactgatgtaatttgaggttcggattaccaagtcctcaaaattggaaaaagttgtttgaaaggcaaactctctcttcaacaatgagtgaaaagcttcaattggcccattatcataaggataaccttgttttgagtatgagtggctgatctgatgccgttcaagtaaagtttcaacttcgttgctggtgtactgtgaacccatgtcagagtgaaaatattgtggtgtcccctttaaatcaaggtccggattttttggaatctgtttattgtctgtatggttaacacgaatttttatataaaatttcaaaggggctataattataaaatcgcccctcaaaaacattgaaagaataacccctaatatctataatgtagatattaggggttatttattttcatattataaaaataacttcttctatttgtcattttttcgataccttttagcacgattttgaccaggaaataaacgatcatgcgatccgactcgaatgccaattaagactagttcatctttatcaatcgtataaaccaccaggacatcgttagtttcgcttggtgttttgtttttcggggtatctcgtaagtgaaattcattataaccgctcattcgccgattaagctcatgatcttcaaattctggtggtaattgttgttgctcaagtaacaggtcaatggctgctcgaacttcatcaataatagatttgtctaaactggctaaccgttttagatcagcattaaaggttgcacgtggtttaaatcttagttttttcattatttaaactgactccaataatcatcatctgattcaacaatttcatcgtcaggtaaaacatggcgtttaattaactgatcacgtgcaattgcatattctaacgaaccttctttcgcttttaatgctctttctagccagtccattttttcttgtgaa

SEQ ID NO: 27 - DNA, 8127 bp, synthetic construct
  source 1..8127: mol_type = other DNA; note = Lactobacillus plantarum PDG8 - contig 27
aatggcatgaccccgaaagaatttcggaatcatgccattctaaaaactgcatagctattttaattatttgaactgtctacttgactcggagcagtcccgacaatccgttttttttgatgcgattaaatgtagttggcttaaactaagccttgcgctaacatggcgtcagcaacttttgtgaagccagcaatgttagcaccactcaggtaatcaccgctaacgtggtattcgtcggcagcggcaacggagtgtgcaaagatatcttgcatgatttgtttgaggcgattatcgacttcttcaaaagtccagctcaaacgcatactattttggctcatttcaagggcggaaacggcaacgccaccagcattggcagctttggccggaccatatagcaagctggcagcttggtatgccgcaatggcttctggactgctaggcatgttagccccttcggcaacgaccttggcaccattggcaatcaagttcttggcttgatcaccgctgatttcgttttgggtggcgcaaggtaacgcgatatcataagctacttgggcgtcccagacggaaccttcgtaatagctggcactggctacacggtcggcatagtctttgatgcgaccgcgttcaacttccttgatctgcttaacgatcttgaagtcgataccgttttcgtcaataacgtaaccgtttgagtcggagcaggtaatcaccttgccaccgagttcttcaaccttttgaatcgcgtagatggcgacattaccagcaccagaaatggcaacacgttgaccagggaaggaaagttggttggccttgagcatttcgttggtatagtaggcgagaccataaccagtagcttcagtccgggctaacgaaccgccatagttcaaacctttaccggtgagtacgccgcggtcagcgccccggagtcgcttgtattggccgtataaaaagccaatttcgcggccaccaacaccgatatcaccagcaggaacgtcggtatcgagaccaatgtacttgctcagttcggtcatgaaactctgacagaagcgcataatttcgttgtctgatttgcccttagggtcgaaatcagagccccctttaccaccgccgattggcaggccggtcagggcatttttgaagatctgttcaaagcccaagaatttgacgatactcagattaacggatgggtgtaaccgtaagccgcccttgtatggaccgattgctgagttaaattgtactcggaacccacggttgactcgtgcatgaccagcatcgtcgagccaaggaacccggaattgaataatccgttctggttcggtcaaacgttccaaaatattggcttcgatatattctggatgttgttcgaggactggcgtgatcgttttgaagacgtcgttgatggcctctaaaaattcggtttggttcggatcacggtgttcaatgacttggtaaacatgttggacataatcggttgcttgactcaatatgatcatccttccttgaataagttaactataatcttcattttaatggtcacgttcggaaattgcacgagttaaattaactaaattttgatgaatttttagtgattgtggtaaaaccgtgctgttgatagcgcttgcgatttggttcggcggactaacaataattcgcattttaatgcaaagtcagaagcgagggcgtatgcttggggcaattaaatagtagtcaagtcagatttgacgggcgactcatcagaaacagggggggatcatgatgaacaaacggcgttggttattaagtttattgccaatcttactggggttgattggcgtgggtgtgtggggatcacagcaagtgacaccaaagacaattaaagtacagcaggcagcgtcaaaaatcaaatccgcgacgaaaaagcaaacgacgactaagcctaaattgaagcccggccagcttactgaggcccaggcaatcaagcaaatcgatcagttgatcaaaagtcatcatattatggggacactattactgaccacgaacggtccggcgggggtccgggttcgaacgtatggttatgcggatgatgccaatcaagtccgcaatactgcgacggaggcttatccattagcgtcattacaaaaagctgtgactggcgtgatgattcaaaaactgatcaatcagggtaagttgagtctgacgacgaagctgagtcacttttacccggaaattccgtacgccaatcagattacgatacgtgaactattagaccatcgttccggtattcggatgactgagataacaccaaagacgattttaccaacggagacggcgcggctgaactttacactgcaacatttacggtcgacgaataatcatgcttatgcctattccaacgcgaactttaccttattggcaggggttattcgcaaagtgacgcataaatcctatcaggcggctttgactaatgacatcattcggccattgggattaaaacatacctatgaatataacgatattccgggcaatgtgatcaacccgacttcgtatcgcttggctaatgggtttggtcagagtggcatcatttctaagccgttacaatctagtgaattaggctgtggtagtctatatatgagtgtgggggattattataaatttatgtatgggcttcaaagcggccagctagttggtgaagccggtttaaagtcacttgcggataattttcaaattaaatattcggcaggcgtttattaccaggcaggccagttgattcgagtgggtggcaatgacaataattttcatagctactatatggggtcgcgaaatgcccaagtcgccttagtcttatttgaaaatcagggtgtttttggtggtgacaaccaggtcgcgtataagattcgtgatattttattgaagacggtacctttttagaaacggtacgggctgaacatcatcttaattgcgggagaacgtgtgcctgcaatcaaggtggtgtttttgcttacccgtccgtttggctgaatccttgaaaataactaaacttttactcgaaatgatggcgccacgacgtaactaacgctatgatgagattagaaactaaatgatgcaggtgaaagttaatgacaaaaccaattaaggtaatgacgattttcggcacgcggccagaagcaattaagatggcgcccatcgtgttgcagttgcagcaacagccacaatttgaaccggtaacggtggtgacggctcaacaccgcgagatgttagaccaggtgctcacgatttttcacattacgccggactatgatttgaatatcatgaagcctaatcagacgttagctggtatcaccagccgggtactgacgaagctagatgcaattatggatacagtcaagcctgatatcgtgctggtgcatggcgatacaaccacgacgtttgcagctagtgtgagtgctttctatcatcaaatcccagtcggacacgtggaagcggggttgcggacgtggcagaagtactcgccatatcctgaagagatgaatcggcagctgaccgacgtgctggccgacatgtactttgcaccgaccgaattaagtcggcagaatctattgaaggaaaaccatccggatacggccatcacggtaacgggcaatacggccatcgatgccttaaaacagacggtttcgatggactatcaacacgctgcgcttgatttgattcagcctgggcaccggatgatcttactcacgatgcatcggcgtgagaatcagggcgccccgatggaagcggtctttgtcgccatcaaacgagtggttgctcagcatcccgatgtcgaagtggtctacccagtacacttgagtccggcagtgcagacagtcgctaaacgtatcctcggccataccgatcgcattcacctcattgacccgctcgacgtgcttgatttccacaacatggcggcacgcagttacttcattatgacggattcgggtggggtgcaggaagaagccccgtcactgaataaaccggtgctcgtattgcgtgatactactgaacgaccggaaggggtcaccgcggggacgttacgattagtcggcactgatggtcagcaggttgcggcagcaatgaccagcctgttagatgattccgcagcgtaccaacggatggcagacgctaaaaatccttatggcgatggtcatgctgcggaatacatcttacaagcgattatgaaaaaaattggtacacattaaaattatttgcatttttgtataaacagtgtaatattaagcactgacatagtgataaaaattttcacttctcctgtaaagatgtgaaattagtgaagtagccggagatggatgccgcgggggtatcaataccggttatttttttgcgttaaaatctagatggcccggtactactgagtgtctaggcagctacttgattttgtcaaagtggctgacggctgggagataagcggattttactcgtcagtggtcaggtattgccatcaattgatctgattggaccgactagtctattcgctgaaagcactaatcctagtataaaaggtgtttcccgcggcattccattgtataattgtaaatactataagtgagcgttgaggataaatgaatgaatttaaaagcccgttaccctaaaattgcgaaaagcctggaaattattattcggcggtatggacaagccaatgtcagcaacaatgcgattgtgctggcctactacgcgttaatgtcgattgccccgattatcttgattgccggaaacctcattgcccggttcgatttgaagtctgggcagattttagcgtacgctcaggaagtcattcctagtaacgtctaccagacgtttaagccgattttagtttcattcctgtccagtggcagcagtagtagtttgtcaattgggattttggtgacagtctggtcggcgtctaaaattattgctgcaattcgcaggagtctaaatgaggcgtacggggttacggatgcccaaaatgccgtttggacgcgaattattgcctttttcttaacgttgggactattactcctaatcgtagggctggcgattttcttcacgttgagtcaattgattctagatgtgatcttgaatttaacaaatctcacgcgtgcaatcattccgaattggattaatcagttgttggaaaacaagaacttgattacctttgttgggatgttcgtcgtcgccatgttgttgtattactttgtaccgaacgccaaggtgaaattgcgttacatttggacgggggcgttagtcacgacgattggctggatcgtgatctcgcaagggttccgggtgtatatcgaattatttgctaaacggattacgacttaccaaacgattgggagtttaattgtactaatgttctggttgaacttttccgggattctcttgatgtttggtggcgtcgtcaatgcgtcggtgcaggaatggtttgagcataagattgagccaaagtctccacggatgattcgtcgcattcggcgacaattcttcaaacgcaaaaaaacgactaaaaaagaataatcagaaccttttaattgaatccgaacgtttaatcctgtaaaatcaaaactttttgcgatttacatattaaacgattcggattttgtgtataatggtgttcgtgtgaaaaaagtgccggtgctttctgaaagtaagtggcgtctatttcaaaataaacaggcgtaacaacgccacaggaggagaaagatagtgattcatcagcttttggcagagttcatgggaaccgccttgatgattatttttggtgtcggtgtacattgtagtgaggttttaaaggggaccaagtatcgcggttccggccatatcttcgcaattacaacatggggttttgggattacaattgccctcttcattttcggcaatgtctgcattaacccggccatggtattagcccaatgtattttagggaacctttcatggtcattgtttatcccgtattcagttgcagaagttttgggtggggtcgttggtgccgtgatcgtctggatcatgtacgcggaccattttgccgcttctgctgatgagatttccccaattacgattcggaacttattctcaaccgcacccgctgtgcggaacttaccacggaacttcttcgtcgaattcttcgatacatttatttttatttctgggattttagctatttctgaagtgaaaacgccggggatcgtgccgattggtgttgggctcttagtctgggccattgggatggggctaggtggcccaaccggattcgccatgaaccttgcacgggacatgggcccacggatcgcccacgccatcttaccaattaagaacaaggctgacagcgactggcaatacgggatcattgttcctgggattgcacctttcgttggggctgcttgtgcggcgttgtttatgcatggattctttgggattgggtagataatactataattactttggacggctattgtaaaaatagtcgtcttttttatcgatgtttacacaacaatataacgattgcccttttacattaaagtttttttgatataatgacatgatgagactatatattcttggaggaagttaaattgagtaagtatgattatttggttgttggtgccggacttttcggcgcagtctttgcccatgaagcggcattgcgtggcaaacacgtcaaggtgattgaaaagcgggatcacattgctggaaatatctataccaaagaagtaaatggaattcaagttcatcaatatggtgctcatatcttccatacttctgataagcagatttgggagtatgttaatcaatttgccgaatttaatcgttatacaaacagtccagtcgcaaattataaaggacatatgtataacttacccttcaatatgaatacgtttagtgaactgtggggagttcggacacctgcagaggcacaagcaaaaattcaggaacaaaaagacgctgctcagttaagcggcgaacctaagaaccttgaagaacaagcaatatcgttaattggtactgatgtttatgaaaaattgattaagggctacaccgaaaaacaatggggtcaaaaggcgaccgacttaccagcatttatcattcgtcgactgccagtccgctacacatatgataacaactacttcaatgatacttatcaagggattccaattggtggttacacgcaaatcgtcgaaaaaatgttggatcacccagaaattgatgttgagaccggtgtggatttcttcgccaataaaaatcagtatttagccgactttccgaagatcatatttactgggatgattgatcaatacttcaattatcaattaggagaattggaatatcgttctttacgatttgaaacggaagaacgagacgttgacaactaccaaggaaatgctgttattaattatacggatgcggaaacaccgtatactcgaatcatcgaacataagcattttgaatttggaaaaggtgacaagggtaagacaattattactcgtgaatatccagctaactggaaacgcggagacgaaccatattatccagttaataatactcgcaataacacgttgtataagcaatacgctgaacttgcaaagcaggagggcaacgtgatttttggtgggcgtctagggcagtatcgatattatgatatgcatcaggtgattcatgcagcattagtgacggtgaagcaagagttaagtaatgtagaggataaataatggaattacgaattaaattaaaaaatgtgcttagaatcattggaagacatattgttttgttaataggtatcattggtttgtcaattgcagctggtgttagttggaactatttgattaaaaagcctgaatatcagtcgcaaatacaatttttacaaactaataatgatacttcacaaattactgtttatgatcaaattttgagtcttaaaagctttaaaacacaagtgaattcggagttgaaacaaagaaaaatttcttcggtatttagtgatacaacaattgaaagtatgtcagtgtcatcatccgttaaggtagcgtcaagaatcttgtgtaaatgaaatgccttcgtacatataatatgtatctaacttaaataaatgatgcttccaaggtgtcctggagtcctttg

SEQ ID NO: 28 - DNA, 7100 bp, synthetic construct
  source 1..7100: mol_type = other DNA; note = Lactobacillus plantarum PDG8 - contig 28
aattaaccagcgaccgcttaaaatactcgactggcaaacaccgtatcaggttatgctgacaaatttgtccaaaaattcggattaaatttgcaatctaccgaatagctatgttacactacttttaattaaagaaatcgtttgagtatcgagagttcggttagtggctacacacaatgacccgacagcaacgtacaagggaagccttgcaacgtgcttcaatgtagattgatattctcctaagtaaggaaccgcttagtgtgaatattaagcggtttttttagtgaaaaaatatttaggagaattactatggaattagacaattcaatacagcaaatgataacaaaagatttagtacaaaaaatgattacttctatgggtggacaatcgaaaagtagtatttcaaacattgattcaaaaatattaactgttttagaacaactttatcgtgagttaaattttagaccgtgctctttggctacttctttagcccatggatataggaaaaatgatttaattgatgaattaataaggttgttaggttatcaatcagtgatgagcctttgtaattaaataaaaaataggccagcagattacactaagtagcttgctggtttttattacgttaaaatcggttttaagacgttttattatgcttgggtataataaaacaatgcaccttaaaatcgcttggaagacgttttaaagggtctatacgatgtgctgtgttgtggtgtgtgattgcttggtgttgaacgtatagattagatactatttggtcgtgaaatatttatcccgctacttttattctaataatgttgatacaatctaccaaatattacaattcattacaaaaacggccttatattacaagcaccccctaaaaacgtaatgttctgattattgcactgtaaacactcactagttatactagtcactgttgattggttgagacatcaactgctcgaccaatagaaaatatatgtaaataatcgaacacacgcaaattataggagggtgtattaattattatgaaaatcaaaaaccttgtattatcatcaactgctgcattagctttattcgctatctcaacaacggttgccaacgctgatacttatactgttaaggccggcgatactgtttcagcaattgcccaagctcacaacacttcagtttcagccattgaaaaggcaaacaagttagctaatgttaacttaatcttcattggtgataagcttgaagtcaatggtactactacaacaaccacgacttctgctgctacaagtgctgcaccacaatcagcaactagccaagctacttcttcaactgcaacgagtgccagtgcaactagtgcttcttcacaatcagttgctagccaagctactagttctgctgctacttcttcagctgctagtcaagcttcatcaagtgctactagcttagctgcatcatcaacagcttcaacaacctcaacgacttcaacacagacgactcaacaaacgaccacgacacaatcatcagctcagactagtcaaactcaagctcaaccgagccaagctagccagacccaatcaagtcaaacacaaactagcaaacctgctgctcagacgacgactcaacgtctagtttcaacatcaaactatagcaacaatggttctgatagtgctgctaaggcttggattgctggtaaagaatctggtggttcatattctgctcgtaacggtcaatacatcggtaagtaccaattaagtgcttcatacttaaacggtgactactccgctgccaaccaagaacgtgttgctaacagttatgttgcttcacgttatggttcatggagcaacgccaagagttactggcttgctaatggctggtactaaaaagccactttaaattaataaataaatgcaaagattgcggatcatttctgattcgcaatctttttttctactattaagtccgtgctgaagcacgtgtgtccccccaccaatacccattacaaagttactcagttgctaagtgactttataataggccttagagcatgctgacaacccgttatttagatatgcgatatgcttattctagcaaccgctttaagacggacacgatccagacctgctagttgtctcccccaatcgacgacccactctcccaaccaaaataccgcatgtttttatttaacaattcaccaaccttaacggagaaaatccaactaatttcctgactaagtacagtcccgaacccccgacagtttgacgactagtccacaacgacaaccacataccattcagctatggcgtaatactaacccagtaacgttttagtagcgatcgtcatgggctacttttggcataaacctactatagtaatacttaattaatcgacgccttcgttaaccgaccacaattgactacacgatgcgcaacttctatcaattatctgctttaccgaaaaataattagtcagtaccacgtctccacgcaataaaatgactagttaagtgtcgctgtaatcagacctcccgacaaattaacccgtcaaaattcactagttaagtgcttaaaattatcgataatcatcgttgacttttcataaatcgaccaaaagtgattacttttatcggataaagcggctaattttcatcattagtttccccaattaatcattgtcgttattgattttccagctagttaatcgggattggtagcgctattttacaatctaccatttacacaagatattttacgctctcggtaactctgctgggtatactagtatcaacgatacgtacactatgtataatgatgcccaagtaaacataactgctgaaaaaatcaagaaaagcaatgggcaagtactcttcaataataaaattaaacctgaagtgcaaactaacaggccaattgttcaagcaaacaattggctattaactaaaaactagtttttggttagagatcggttgatctctagcttccactgtataatagattaaacaagaagttttctacgtaaagtcaagtatattaggactctaaagtcttaatttctgacatatttgacatcattgctttaatcggggcgttttatttctaaatttggagcatcacaaaaggcttcaaagaaattacttctttgaagttaacctaggctataatgaacatgatcaattaattacgacaaaagtctttttgattattgttggctacgttgtaatcatacatttgatcggtgataatcaaaatgtagaccgttctaagcaatttatggattgaagcaatggcaatttttaagggcggtggctgtcttttaccttgcgaggtgaggccatgggaacatggaataatcttcaggaaggtttcacagtcaatgagcgtcttccaggcactctcgttgatgttgctgtttggcacgtttttaatcgcgctactcagctatatcgacaagcaccacaaataaaaaagccgccctgcgtaactttggtaggttacagggtagcttaatgctgtcttattaacttcgccaccgcctttgaagcggcttgcgtaggaagtcttgttagcgcaaggcttccttttctgtctacattatagcatgactatgaaaaattgggtagcaaggcattttcggcatattatttatctttgtatttttcaaaataggttcaactaattctgtttcagcgtttttcgtacttcaccgtatttgtatatagttttccaatatgtttatgtctgccaacggatccacttaatctgatacctaccattatgataaaccaatttacctattaacttagtcttggtgctttttttctaaggttgctaataatgcatcaatccgttgtttaacttggggtcgttgggttgtatcagttaacagtactaacgtatcaccttcatgaatcaaggtgtcaccatgtggaatcacttcttgttcgccacgccggattccaatgagcagtgcttctttaggccatggcatgtctcggaccattttgccgtttaagggactgccaaagaaaaccggtatttccaaatgatcaggtcgatgaagttgctgaacagttttaggcattgtcatctgcttaagcaatgcttcatagattggtgcaccgcctaataaatcaacaacaaggtaagcagttaacgatatgactgctaatggcattaaatgtgttaaattgccaaccatttctgttaccagcaagatagctgtgaagggagcttttccgattccagcaaagtaaccggccatggaaaaaatgattaggttcatgatatagacatgcgataataatcctaattgattcattaagacgccataaaccgcaccaatcacagcacctaaagaaagaatcggcaagaaaataccgccaggtaatccggaaccatatgaaatcattgaaaagacgaatcgtataataaaaattgcaattagtacaaacaaaggtggaacatactggccaaatccaacaattaagccattaccaccaccgagtaaatttggcgaaaagtaaccaactaaaattaccagcagaaatggtacgataccttgtattgggcgtggcaaatgtgtcaattgatgataccacctaggcataactaacaagacccgttgatataagtaaccaaataatcccaaaacaatgccgagtaaaattaagtgccaataatttgatactggtaaactacgtgaataacttaaatgtaacacgggaacaagtccgaaaacattcagcgaaataaaatttgaaccaattgctccggctaatgctgttaaccaaaccagcggtgaaaaattatggtaaatctcttctaagacaaatagagttccagcaatgggggcattaaacgctgctgctaatccagcagcggcgcctgatgcaattagtagtcggcgatcagttcctgataaatcaaacccagaagcgaaaccttgaccaactgacgcacctaattgaatcgacggtccttctcgtccgagaaataatccaggtcccaatgccagaataccaccgataaattttcgccaaagaattgaccaccagtgcatttccaattcaccagccaattgaccttcaacttgcggaattccagaaccagcgatataaggttctctcttgagaagtcgagccacaattaacgctaaaccaaggttgatgccaatcaacaatgcccattcccaccaaacaaacggcgcgattcgtaagtatctatataccaatcgactatagtgcagccctatctcaatacaatagcgaaataagctaacaacggtgccactcattaaacccacaagcaggccgagtaaaacaaatcgcaaacgagtaacgtcaaatttttcttttacaagctgtatcaaataactaatcctccattataaccaatattatataatttagtacttaattaaactaggcaatatctcgatgaaatctagtagttatttttcacagagaaggggtgtcataccgctaaaatgttttagtagtttatatgacgagccgcatgtttgagtagtaatggtgctaataacgttgttaggataatggcagtgataattgccgaatagtaatcatcactgattagtttggcttggtagcctatttgagcgataatcaaggccatttccccacgcgagaccatccctgcaccaacgaggtaagcttcattcgaactgaatccggcccatttagccccacttcccgctcctaatagtttcgtcagtgttgccacaattgtcaatacgataattaataacaaatcgtgttctatgccagctagtgacatacttaaaccaattgaaacgaagaatacaggaatgaaaatcgcataaccgattggttcgatactttgatcaacttcatgagctacatgagtttgtgcaatcgcaattcccgcaaaaaaggccccaattactgcactcagtccaatcagatttgcaatatatgccataccaaaacacaaaatcatcgccattatagtaggtcccactggattcaataatttggtgcctagtctagcgaggagaggggcgataaaacgcatcacgaaataaattgcggcaaagtaaattagctgctctaaaaaagtcagagctagcggtatctgggtatccgtaccagcctttgtacctattaaactgaccataatgctaagtaaaacgacagctagcacatcgtcaaccaccgcggcaccgaggactgttgaaccgctcttactatcaagtaaatttagttctttcatgacagcaactgaaattgaaaccgacgttgcggcaaaaataacgctcaaaaacaagctttcaaattgtgtcaagccaaaaacaataccaactggatagatcagtaccattggaatcaaaactcctaacaacgcgacaattatgctaggacgcaaatattttttaagcaatgtaagatcactctcaagtccggcgataaacattaagatgataaccccaatctctgaaaaaatatggataaaatcattggcgtgaacccaattcaacaacgcagggccaagaataattccaacaaataattgaccgatcactgctgggataccaaccctagaggctatatggccaaatagactagttgcaatcaagatgatcaccaaggtacctaaaaattccaaacaaaaacctcctcatacaaaaaacgtaaacccagatacctcttccacacccctgaaagagaacaccttgagcttacgtcaaccgatttatttattcatattttgataataccctttatatgatagcagactaatcaaaaatattcaagtaacgataagttgtcgtatttagttacttatttcgaaacacggacaccgccaattttaaaagtgacctctgaattttccggcatatgtgccggttcgcctgttttagatatcggaatcgtcttctccagctataaatcatgctggatacataaccgagctaaaaagacaccgtaggtatattatcacgtccaagtaatccaaactagggtccgtctgaaaactacttaagtaagatgcaaattgaggcaatgtagaccgtagccagataaacatgagcgagcttatcataacacgttgcaatcctacgaaagttct

SEQ ID NO: 29 - DNA, 6625 bp, synthetic construct
  source 1..6625: mol_type = other DNA; note = Lactobacillus plantarum PDG8 - contig 29
tttttcttgtgaaacgatggctactgcgcgactatttgaacgagcaatataaacggtttcgtcttcgtcattaacttgatctaaatatttttttaggttagcgcgaaaatcgctctgtgttagtgctaatgtcatatttaccaccctttcattgtacttaatattgtactttaatttgtactaaaaatcaattttttaaggagctaaaactatgcaacaagttgtcttacccatcaaagattcaaacgttctcaaagaggttcaagataccttactcaacaactttaaagctggccggcgtaactatacagtttttcaagttggcaaagcgacactgctgcgagtcagtgatgtcatgcgcttaaaacaggccgatatttttaatccggacggttctattaaacaaaatgcgttcattcacgatcgaaaaactggtaaaccgaataccttgtatcttaaaccagttcaaacagagctcttattgtaccgtcaatggctacttgatcatagactagcctctgagtggctctttccttccattcaacaccctgagcgccatatcacggaaaaacagttctacaaaattatgagtaaggttggcgatctgttaggaattaattatctagggacccacacaatgcgcaaaaccggagcttatcgcgtctacacacaatctaattataatattggtttggtcatgcacttattaaatcattccagtgaagccatgactttagcttatttaggcttagaccaagccagtaccgaaaatatgttagatcaaattgattttggttagttttatttggatttttagttgtcgccaacggcgacttctgatacaggaaatttagcacaaacaccagcgattttaattgtggtgtgtaagtgcgcattgacctcgttttactcggtctgctgataaccatgaaatcagttttttccgttgttgaattgactgtatttttaattcaatttatgtttgcccctaactaagattgttatgttttaaatatttaaaaagtgttgcagattacgctgttttaagccaaatttttttaatcgttctgtgcaaagaatctttatgagtttggtaaaaaaattggaataacggtactgtaaaatctgtaaatctaaactgaaatcattattttgatgttaggagtaatcaagatggacgaaaagaaagtattaaaaccaattgatgaaatgcttgctgatccttggcaagttgatattcaagaattgtttgaatcttctgtcaatgaacctgacgagatcaaaaagaatctgtatgattccctgtatacttatgttttgcaaaaaagacaagaagatattattaatcgtcctggctttgttatttagccctctaaaagcctgctgaggctttttatttttgctttggtataaatatatatataaacagtctcaaaatcgctagaaacgataaataaggcccttaaaaacgaatatagcagttagattcttgttaagattcagaaaaactaactgtttgctgtcaatggtagcggacgagcgtagcgtgggagcataaggaattgacagctctaaaccagtcttaacactgaattggcgaaagccaaagtttctataaaactttgctttcctgcctaacggcgagtgaaaaagcggtcaagctggttcagcttggacggggttcggggcgtcagcgcccgaattaatgtggcttgccgcaccttttaggcaacgaacgaagtgaggcgcaagaagcgtagcgagtggagtttaatgtgagcctgtttttgggctcactcctttgtatttttgttttagattttgatcttgtacagcggtgcctcttttatacctcttttataaacctcttttatacctcttttagacccctcttgagccttactctcccagggaatacaggagtttatggatagagttttgtctgtttatagatagagttttgtctgtttatagatagagttttgtctgtttatagatagagttttgtctgtttatagatagagttttgtagtattatatattcataaaaccatattcattaaaagaggtgcttcatttgagtaatgaaattgttaaatatgatcctgaattaaatacaatcccacttcgaaaattcactcctgttgaaatgaatttattcttctcaatagtttctagaatgcgtgacaagggtgacgaaactgtaaggttttcatttgatcaattaaaagaattaagtgcatataaacctacagcaaataaccgatttattgacgatattgaaagtacttatcaaaaaattttaggcttacgctttggaagacgtagtaaagatgggctgcatcgtgaattttttgttatgtttaccgaatttgagataaacggccatgctgatgatccttatgttgatattaaaatttaccccaaagctataaaattattaaatgagctggaaagttgggttcgttatgctttatcagaattcagagatttaaaaagtagctacgcaaaaaccatgtttcggttactaaaacaatttagaactactgggtacgcttacttttcagttgcagactttaacgagctattagatgtccctaaaagctataaaagtagcaatataaatcaatccgttttaaaacccatcaaagaggaacttacgcctctttttagaggcctaacggttagaaaaaaatatggtaaaggccgcgggaaaccagtgattgggtattcttttacttggaagcctgaaaagaaagacgctaacgacttctcacaaggtcaatttcaagatgaacgtcaaaaactctttaacattcagcataatgctgaattaacagaacaggaaaaatggcgcgccattgacaaggttaaggggctaactttaggctctactgagaaacaagcattggctgataaacaggccgagcacgataaaaaaataagagatcaagcacgaaaagaagcacttgctgaactccgaaaggggtttggaaataatgcctaaaacaattagagaacttgctgatgaattgggcgtttcaaagcaggctatatggcaaaagataaaaagagatgcgtcaatcgatttacgtcaatttacatcaacaaaaggcaatactgtttacgttgatgttgatgggcaaaaagctattaaagcaatgttctcaaacgattcatcaacaagataccgtcaacaaaaagatgatgttgacgacaacaaaaaagatgcggttgatggacaagatgaagtgaaattccttcgaaatttagtatcagaaattcaatctgaaaagaaagagttacataagttactagatcagcaacaaagattggccttacaggacaaacaactgctcgaagaatacaaagcagaaaacgacagattaaaagttctcaaaatgccctcacaggaaacagaattcaaacacttagacaatcaatataaagatgaagtgaacgctcttaaagagaagttggaaaatttgcaggaacaaatcaaagttcaaaaaaggatagaagaacaagaaaaaccaagaaaatggtggggactatggcgaaaatagatgattcagttaaaaagaaagttccagaattgcgatttaaaggattcacggatgaatgggaagagcgtaagttaaaagatatagctcaatttaatcctaaaacagttcttccagatgaatttgagtatgtagacttagaaagtgttgtagggactgaaatgatctcgcatagaactgaatctaaagatcaagcaccttcaagggcacagcgtcttgcacaaaaaggcgatgtgttttatcagacggttcgcccatatcaaatgaataactatttatataatttgccttatgataactatgttttctcaactggttatgctcaaatgcgtcctaacattgatagctattttttattaaatagtgttcaaaacaagcaatttgttcaacatgttttagatagaagtacagggactagttatccagcgattaattcaagtgatttatcaaatattgaaattcatgtaccgtccaaactttcagaacaacaaaaaataggggcatttttccaaagtatagacgacactatcgctcttcatcaacgtaagttagatttgctcaaggaacagaaaaaaggctacttgcaaaaaatgttccctaaaaatggggccaaagttcctgaattgcgatttgcagggtttgctgacgcttgggaacagcgtaagttaggaaatgagttaactttattaaaagatggaacacatggaacacaccaaaatgttcttgaggggcctttcttattaagtgcaaaaaacataaagaacgggaaaataattatagatgagattacggatcgtaaaatatctgtagaagaatataattctattcataaaaaattttctttggaaaaaggagatgttcttctaactattgtcggttctataggagaaacggctatcattgaaaatcctataggaataacgtttcaaagaagtgttgcatatttacgaccaagtcatacgatattatcacaatttttatttacaacaattaatggtcaaaaatttcaaacggaattgaggaaacgacaagttgtttctgctcaaccagggatatatttgggggacttatcaattatccctatattaataccaagtgtagcagagcaagaaaaaattggttcattcttcaaacagttagacgagactatcgctcttcatcatcgtaagttagatttgttgaaagaacagaaaaaaggctttttacaaaatatgtttgtgtaggggctataattacatttagcccctatttacaccagaatattcttcgcaaccagtggttgcttttagtgcgctaataattagcgtgctttttccgcgtttcaatatgataattagtctattgaaagtgaggttacgcttatgactttaggacaacggataaaaaaagaacgagaaaaaagacagtggacgcaagattatcttgcagaaacgcttaatgtttctcgtcaggcaatttctaagtgggaagttgggagtgcttatcccgatattgatcgtttagtgcaaatcagcaatttgttcgacattaccttagatagtttgatcaagggtgatgattcactaaaaaaaagcatagttattaccaaaaacgcaaaagcacaaactaatgtctgggaatttatgtgcagtactggttggataatggtaattgcaattatttattcaatcaccaaaatgattatcgctgtctttagttaagaaacctttaggaactataattaccaaatattccattcagagttttaagcaaactattctgaatggggtatttgagttatactagcagtagaaagtaaaaacacagttcggttggtagtccgaacatagcgaagctatcagtaacctgcctccttggttgtccatctttcttaattaattttaaggaggatgtttgatgtctactatcaagggatcattaacaattgtctatgaaccaccgttttacaaagctattttcgaaagacgctttaattccacttatgaagttagccaaattaacttaggtccttcagaacctaaattaactttgatttacgatctggttattcatcattggaatagaattatctttttcaaacaaactgtttgtgcttcgtctgtttctgaacgaaaaatcaatcctaagcgtcttcaaaggttagctagaaagagtattcagtatggtgtcggtactaaagcacaacaaacactccaaaaacagttggaatgtcaaaaagtaactcgacaacataatagacgtactaagaagatcttggatcaagaaaaaagatataaattgcaccaggccaagaaaatacaaaaacacaagggacattgagaagctagtatagaaaactatgtgttgcattttagggcctataattaacaaatcgcccctcgaaaacattgaaagaataacccctaatatctataatgtagatattaggggttatttatttttatataccagaaataacttcttttattcgttattttttcgataccttttagaacgattttgaccaggaaataaacgatcatgcgatccgactcgaatgccaattaagactagttcatctttatcaatcgtgtaaacaaccaggacatcgttagtttcgcttggtattttgtttttcggggtatctcgtaagtgaaattcattatacccgctcattcgccgattaagttcatgatcctcaaattctggtggtaattgttgttgctcaagcaacaggtcaatggctgctcgaacttcatcaataatagatttgtctaaactggctagccgttttagatcagcattaaaggttgcacgtggtttaaatcttagttttttcattatttaaactgaccccaataatcatcatctggttcaacaatttcatcgtcaggtaagacatggcgtttaattaactgatcacgtgcaattgcatattctaacgaaccttctttcgcttttaatgctctttctagccagtccattttttcttgtgaaacgatggctactgcgcgactatttgaacgagcaatataaacggtttcgtcttcgtcattaacttgatctaaatatttttttaggtt

SEQ ID NO: 30 - DNA, 6024 bp, synthetic construct
  source 1..6024: mol_type = other DNA; note = Lactobacillus plantarum PDG8 - contig 30
cgcctctggcgcaattgtgagcgaaagctgaacaccagtaagatgatgattagcttagccttcctgcgaatactcttgaaaagattctaaacacgttctgataactttttttcagtggttagtggtactagcgtccggttatcaagtgtccgaagcgttgtttaataataaccaattaggagataagatttttaattggggtggcagttctttaggagagcagggtgatggagttgttaagttttatctatcatggcatgctgtcttgcacacggatattttagcggttcagaagattattgggacggtcaatggttggattttattaggtctgtatcacacggctcaggctttagagagtgtgttcatggcggttttaaaactgtttggcttttttgctaattttaatgttggtgagatggggaccctttataagaccatcgtgttattaggatttacgcttttaactgttgggttagggtccgtctgaaaactacttaagtaagatgcaaattgagtcaatgtagaccgtagccagataaacgtgagcaagcttatcataacgcgttgcaatcctacgaaagttcttcaactgattgaagaagttctcaatcaaatggcgctcacaataaacgtggtaatcacaggcccacttgtctttggtattttccttagaacctgtttaaaatctagctaatttggtatgatagttcaaaaaaggtgatcagtaatgaattatcccagtaatatttctcgccgacaatttgaactagtccgtcccattttagaaggtgcacgacaatcaaccagaccacggaaatatgatctttacgacttattttgcgcggtggcctatgttttaaaaaccggctgtcagtggcggcagttaccagttgattttcctcgttggcaatcggtttattattattatcgagtatggtctgaagaacaagtccttgatgaaccttctattttggatcaatgcttaaaaaaattgtcattaccctacgggaaaaacagtcacgctcggctaaaacatcttttataataattgacgcccaaagtgttaaaaatactgataccgccaagcatcatggttacgacggtggtaaacgaatatctggaataaaacgtcacttagctgttgatattaacggtttgccacaagcaatccatatcactactgccaatgtttctgaccgtgatggggctagtgccatgctagcgctaaactgtgaacatttacaacaagttaaatcagttcttgttgatggtgggtacaccggggacaacttcgccgccactgttcaatccaatttaaaagccaccgtacaggtggctaaacgcaatgagctacataaatttgaagtgttaccacaacgctggattattgagcgttctttcagttggttagataaatgtcgtcggctctggaaaaattgtgagcggcaccttaattcaagtcgccaaatgatcattctcgctttcttgatattactcttaaaaagattttaaacagattctaatgacttcttaactaatgaggatagtggcttaccagttttcttagaacccgaagccgtgcaattacttagtttttggtgccgaactcaaaaacaaatgcaccggtttattggcatcatcttgaatgctaaatatcgagttgaaaaggatcatcaggacattggcgtcataatcccacttgatgatgaggaactgaagcctttaataactaaagccttgaggcgctactttaacgcccttagaagcaatgagaaacacatcaagaacgttgaaaactacttatacggcaccatgcaaaacctatttggagtttggtgaaataaacaagcggctagagaatatgctgctaaacaccccgaggaacagaacgctggcaatgaacgcacttggaactaaacggcatataagcccatttaagccgtcttaaacgaacggacacaaaactatattagattgcatttaaaatgtgtttaaagccgttttaggagccaaatattagggcctattagctatccataggaaagatggtgctaccacatggaaattaaatacgataactgctcagtatagctttagtaggagtctgttctgtactgagcatattttcaacagacaaagctgtacttttgtttcgacttactcgttattgaaaggcagttaaaatgaacaaagaaaaattaaatttatggcatcaggaagaacaatatggcattacaggctgggatttttcacatcttgatggtcgttggcaaaatgaacttcttccctggaattatcggaaactggttttaagctatttaaaatcagatatgcagctattgaatatgggaaccggcggtggtgagctgttaaaaacttttcatcacgctagtaatagaacgcaagttacggaagcttggcagcctaacattaatcttctaaaacacacgattgccaaacaagggatcaaggttcatgctttatctgcaaagtatgaagatgccttacctgttaaaaatggttctctgaatatgatcactaatagtcatgctgccttcaacccaaaattaatcaaagataagttaaaaactggcggttattttatcagtcaacaggttggggctttgaacaattattcattgtcacgctttttcgattcggattatgttccggcatatccagataataccttgttgaaaacagtcgcagattttcaaaatttgggttttgaaattttgttagctaaagaagctcaacccagtatgactttttttgatattggggccattatttattacgcttcaattattccttgggagtttcccgatttcattgttgatcactgcttatcacagcttactcaactagatcaattaattcaaaatgacggttcagttactactaaagaggaccgcttcattttagttacccgaaaaatgtaatctattttgattgaatttgagatgctttatcaaactaaaaatgaaccgaaaaaatgattcagaaaataaaaacgatcggcctagttattaggttgatcgtttttgagtttattcggtttatgggcattaacgtaatcggcaaatatctttaaaagttcttcggtttgttcgaccgataggttattagcttgaaagtacttttctaataaagcccctttttgaattaatcggcgagaacgtgctttgcggtcttgccgattttcatagtatttagattgtcgtaatttaaaatcttcccgctcaattttttgttttaaacgcgcttgttgttcaattagtttttcatattgattaggcatggaattccccatctcctatgactaatgatctacggacttttcctttaaaaactcggatacttttttggataaggacttgatattgtcattagataaattagcataaattggcttgactgattatttgttcacctagccgttgttcaatcttatttttttcgtccttaattttttgattaagggcttttaatttagcttcttgtttttctaagttactttgagacataatgattcccccagtcgtattaaaaataatcaccgacactatatcatacagagaacgttaagtcaaagtatgaaagttgaaatagcgaagcggaaggcatacactaaattaaagttaagagaatcagaagaccgagtgaaacgaggtcaatgcgcacttacacatagaataaattctatgttgtgttaaccccattaaaacctgtattagaagtcgccgttggcgacaacaaagtcaagcccatagaatcaaagtaaagaggtgactaacatggcaatatttcatatgagttttagtaatattagtgctggaaaaggacgaagtgccattgccagtgccgcttatcgaagtggtgaaaaattatttgatgataaagaatgccgccactatttttatgcccgctcggttatgccagaaagctttattttaactccaaaaaatgcaccagaatgggccagtaatcgagaacaattatggaatgaagttgaaaagaaagatcgtaaatcaaactcacggtatgcaaaagaatttaacgtagctttaccggtagaattaagtgaatctgaacagaaagaattactgacaaaatatgttcaagaaaattttgtcgatcaaggtatggtagctgatgtcgcaattcatcgtgatcacccggataatccgcatgcgcatgtgatgttaactaatcggccctttaaccccgatggtacttggggattaaaggcaaaaacgcagtacattaaagatgaaaatggcgagcaacttctaactaaaagtgggttcccaaaacaaagaaaaatttggttagttgattgggataaaaaggaaaaaattaatgagtggcggcataattgggcaacaagtgttaatcagtctttagcacaaaaaaatattcccgatcggattagcgaaaaatcatttgtcgatcaaggaatccaagagacacctacccaacatgaagggattaatagtcagagacaaaatagaaaagcgtttaatcaacaagttagagcacaaagaagcactcaagctaagtatcataatattaacgaaaagatccgaaatcatgaacattttgacgcattaactgacgagttatcattttccgaaaagcacacgattagccacctaagtcaacaactgaaaacttatgtcgatttagaacacttagatgacaagcaacgcatgctatttaattggaagaacagcttattaatcaaacacgcggttggtgaagatgtaaccaaacaactgctgactattgaccagcaaacgacatcactagcacaagctaaccagttgttaaataaagtggtggaacgagcaacgaaaaagctttatccggaacttaattttgaacagacaaccgcggctgaacgacgggaactgattaaagaaactaatagtgaacaaacgattttcaaaggtggcgaattggcagaacggttagcggatattcgaaacgacttattaactcagcaattattgacgtttaccaggcggccatataccagctggcagttagttaatcagcaaatccagacgattgagaagcaattaaccacggtactagccaaacatggtcaccagttagacgatttgaagcatactgatcggggcatactagccgcttatcaaccaagcgaactcgaattcatttctaaagcggtcaaagatttacgggtcatgcgggaagttaaagccgtggtgcaaacccaatacgacagaattctaacgactgcttttccgggcagtgacctggataagctagagacgattgataaggagcaaatctataccgctgtggtttactatgacccagaattaaagccattaagcgccgatgatcttagtcaattacaacagcagccaccggtagtctttactagtcagcaacaccaagccggtttaaattacctgttaggtaaaatggaattaaaagatattcgggatcatcgactgcaacgggtcttaaaacatgatggcacccggcaactgtttatcggcgaatgtggccaagatcctaagttggatcacaaacaaattgaaatggtgcaaacccgtttgaaacaacagacaatgcgctttgatcaatataagcaagctcaagttaaggactatcaggccattaattaccatccaactagcccgaaaaattacctgatgaatattttggacgaagccttaatgaccattttatatgcgaaaaatacggactatctaagaaaacagcgactacgtggactaaaggagaccgagtgggaaatgacgaaaaagcaacggcaacaccaaactcgaaaccggcatgaagatgggggcatgcacttgtaatcaaaaaattagcgactggttaattggtatgaatggtagcccataatgtattttacaatctacctttttagtattattatccttaaaactatcaactataactaatttaaaatcttcacacctgaagggaatggatttaacaaatctactcaaatcactataa

SEQ ID NO: 31 - DNA, 4546 bp, synthetic construct
  source 1..4546: mol_type = other DNA; note = Lactobacillus plantarum PDG8 - contig 31
gttttctgtggttactaaatatcataagggaaggcattccctatttctatacaattcagaaatcttttatgcatttacacaagatattttacgctctctgatatgatcgtcacgcgcacgtaagaaggtaaactgtatgccaagcaacataatccgtataagtttttaccttggctttccaaaagaaataaatcgtggtgagtttgtctacagtaaactgaatgtaggccatttgtggtagacttttgatttttatgctcaaaagcctaccacaaatggcttttttagtattaacttaattttacaaaccgggagattttaacaagttgttgctaaagacgtgttatagtaaaacactaaacgtatttcgatgaacaaaaaatgatctgatcccagtaaaatactgagatcaggtcattaattaaaattaaatataatttttttaacttgtttgtcgcacttaaactgctacatattcacttttcggtcttacttaagctacctcgatgataaattttcttttgaattaagtactgatcccgatcttgagtaataaataacggggaactttcttctatgacattgctaaactccaaaccataccatgaaacaggtgaggccgtaattttctgcaaatagatgcgtcccccaatcaatcttctatctaacgagcttaactgatcattgacaattaaatctgctggttgttcctttataatgacaaacttaaagtcgccgactttccgttgtcgctctgttgaatatgtgggtatttgtggctctaaaataccttgttccactagatgatttacaatttgatgtaaatagatactaacggattgagatttcctaaaccctaagtacaattgaatgttaacaacattatgcgtctcaagtaaatcaactgtataattactttcataaggtgcattggtttcattgactgtaacaaaccaataaactttagctcttttaggttgtctgtcgagaatagaatacatggtactacgcttaatttggtaatcacccttaatcttagtcatatacactaagttagtcgtgaacaaaggtattgtattgtctgcgcttaatttagagagttgatcacgatagtcaagaagtgaaacatactcgctttctttttcataatgttctcttcgtttatttccaaagtaccaaagccacataatataaagaatacccaacatgattgttaaggtaacataaccgccatgaataaacttaaccaaacttgaaattagaaagattagttcaataaaaccaaaaaacaaggcaattataagcgccgttcccttatttaggtgtttatttaaaaattcatgcaaaagcacggtagtcataagcatggtaatagtgattgctaaaccatacgcagcctccattttttgtgagctaccaaagaaccagactacactgattgttattatacatagtatccaattaacagttgcaatataaatttgattttttatattacttggatgtctaataaccattctaggtaaaaattttaagccaattgcttcatcgactaaagtgtaagaacccgtaatcaacgcctgagaggcaatgattgcagcgagtgtggctagcaaaatgccaactaggcgccaaggccctgggagcatttcataaaagggatttaagttcgataagtgcctgtaagcagtgtcacctgcatgtctaattatccaagccccctgacctaagtaatttaaaaatagggtgctatatactagtggccaggttacataaatattcttcttgccaacgtgacccatatcggaatataaagcctctgctcctgtggttgccaaaaagatacttccaagtataaagattcccactttgttaactggactgaagagtatcttaattgcataatagggagaaatagccttcaatatcattggataattgattagattaacgattccaaagacagccaaaaagccaaaccataaaatcatcactggtccaaaggatttcccaatcacacctgttccaaaacgttgaatcataaataatacgagtaaaacaactgttgtgataatcaagacattatgttgagaattactaaacaccacagggccaaggtgttgtttttttaatccctcaatggctgaagtcacagttactgcaggagttaatgttccatcggccaaaatagccgccccaccaatcaaggttggccaaattaaccattttgaattttttcgaaccaatgcatataaagcaaaaattccgccctcacgcttattatcggcttgcattgcaatgacaacatacttcaacgttgtaatgatcattaatgtccaaaaaatcaacgagatcgatccaatcacgtaatcgggagaaatatttcccattttaccggcgtcaccaatcaatgcattcataacatacaatggtgaagtgccaatatcaccgtacacaattcctaaagtaacaagtgcccccgcaaaagaaacacgttctagttgcttattcatatttgcttgcccccaacgttaattattgaaatatagcattgcaaaatactaatcctaaatacgaagaaaagcaactgtgttttgcagatcagttgtagcatgagaaccttatatcgactttttcaaagagatattttcaatgtgaaattgttgccaatgaaaggtaaaaggcatccaaatggttacgttgaacggcgtggtaaagctggccgactcggcagaagtatttatcaacgctatcaggattatcctcattttcaacatgaatttggtcatctagaagcagacaccgtccaaggcaaagcacatcaaggtgcagttatgaccttagttgagcgtctctccaaagttgaaatcattttaaacatccaacagaaatcggctgaatgcgttaataaacatcttaatcaatggttgtcccaacagccaaaacaccttttcaagtcaattacttttgataatggtaaagaattcattggttggaaagaaatcgcaaataagcatgatattagtacttattttgccgaagttggggctcctaaccagcgtggcttaaacgaaaataacaatggactaattagacgagatggtctcaacaagagcatggattttcgcaatttaccaaatgctttagttcaacaagtcagtagccggcgtaatcatattccaagaaaatcattaaattataaaacaccaattgaggtattcatggaaaacatcacagataaacagctatgttatttctaacttaatttgacatttcaaggtattaaagaatatgctttaaaagttggagacttaggcactcccaaaagggaagtgaatagctagggcctacaggacaagttagtgttttttagggaccatcggtcaaataataaagcacttacattgataaaacattttggagatgaactatgttttttaaagattggacaaaatacaatggtttcgaattagttatgattacgttgggatgtagcatttatgcgttcagtctagatttagtctctattccaagtggcttggcagacggcggtctgagcggaataactctgattattcgtcatttctttcatattaacttgggtattagtactttatttctgaatattccattgatactaattgggttgcgctacttaggcaagcgcatgatggcttacactatttatggcaccatttgtttatcactatttctaataatatggtcacagcaggctctgattcaaccactaccattgagaaatgatttattattgtcatcactggttgcaggggtattatcagggttgggaattggtctggtttttcgttataacggaactactggtggtagtgatattattgctcgggttggccagagaagttttggattttcttcgggaaaaggaattttgattattgactacgtagtattagggctatcactatcatacttagatctgtatcacatcgcgtactcgctaattgttagtttcgtattatctaaagtaattgatatggtccaagaagggcccaatcgtgctaaggtattattcattgtatcagataaaagccaaaaaatttcccaattaattgatgtttctttaaatagaggattgacatatttgcaagctgaaggtggttatcagcatgatcaaaagcaagtgatttatttggtggttcaaccgcgggaaattccacaattgaagcaattaattaaagcgattgatgaacgggcatttgtgacggtactggatgcccatgaagtgattggagagggctttagttatcaacgcaaaagataccatgttaattggcagcacagtaaagaataaaaattaatagacgttttaatatgaaaaaacggctataatctactagggactgtctgaaaactaaaaattcaggtataatctgaggaaaaacgaatcgaggcattccgatgacagcacctaaacgatacgaactggaagatgctcagtgggaccgaatcaaaggatacttcccgccataccggactggccgtccatcaagcctagacaaccgta

SEQ ID NO: 32 - DNA, 4458 bp, synthetic construct
  source 1..4458: mol_type = other DNA; note = Lactobacillus plantarum PDG8 - contig 32
gtattatatggcttaacagaaatagcatcaatcggatttcttaataacaaaaattgggatcttggtactaaagtaattagtaacaccttagcaatagttggtagcgtcaagaatcttgtgtaaatgaaatgccttcgtataaaagtagggtttaatacgcgttatttggctgcacaaaaactttaagcgtcttcattataatttcaaaatcaagccacaaactacgattagctatgtatatcaagtctaatcgtaacattccatcaaacccaacactatttcgaaccgtggcttgccacagcccggtacagcccggttttacaagtaatcgctgtttggcatagtcagtatattctgcaacctctatcggcaacggtgttctagggccaactaaactcatgtttccaattaacacatttaacaactgaggcaactcatctacactgtgttttcgcataaaatggccaatctttgttactctcggatcatcttttattttaaacattgcccctttgacttcatttttactttttaaatgagacaacattttatcagcattagacaccattgaacgaaacttatacattttgaatggcgcttcatttattccaaggcgtgtttgcacataaaaaacgttttctcttgggctactgatttttattgcaataattaatattagaaaaacgggcgttaataaaagaagtgctgaaatactagcaactatatcaaataggcgtttaataaagcgataactcaaatcattccttttgcttctaatatctataaaaatatgttctattttttcctctatcttgcatagggtcacacaacctttactccgataaaagctttgcaactgcactcttccagtcaggaattataaatccagtttttttggccttgctcaagttcatcactgaatgccgtggccgacaagccttttgtggaaattgttcagaagtaactggtactacttcaacatcagtgttcttcaaaatttcttttgcaaagtcataccaggtggctgtattatcgttgcttaattgataagtccctgaagcggcctcagttttcactaggtgaaccataaattctgctaatgttcgcgtccaggttggccgtccaagttgatcattaacgactgtcaacttatcatgtgtcttcgctaaattctgcattgtgaagacaaagttatgtccaaattcaccgaaaacccagctagtccgaacaatataataatcagcaccactgtgacgaacggcttcttcaccagcccacttagcacgcccgtactcattcttgggattggctggatcatcttctaaatattcacctttattggtgccatcaaaaatatagtcagtagaaacataaaccaatttaacatcctgttcagctgctacttgggctaaattttttgttccatcaacattgaccagccaattgagggctttgccttcatcttcggccttatcaactgctgtgtaagctgcgcaatcatataagaccacaggttgtaattccgcaaccttagctttgactgcatctaggttcgtgacatccaattcttttttagtcagtgcatcaaatgcaatcccttgttcatttaatagtcgttgcaactcattccccaattgaccattggcaccaacaatcattacttttgacatttagaaacctcctcctctagcatttcacactattattgcccgttcttggcgtagtttgattcaaccttgctcttatctgcttgccaccagtcttgatggtcagtataccaatcaatcgttgctttcaacccagaccggaagtcagtaaactctggctgccaacctaattccgtgcgcaacttagttgaatcgatcgcataacgtaaatcatggccgggacggtccttaacaacatcataagcatctttagtctgacccattaattcaagaatcatttccaagacgtccttattgttcatttcgccatcggcaccaatcaggtaggtctcgccaatcttacctttggttaaaatatcccaaacggccgcagaatggtcgttcgtgtgaatccagtcacgaacgtttttaccactaccatataattttggccgaataccacttaaaatattggtaatttggcgtggaataaatttctcaatatattgataaggaccataattatttgagcagtttgaaatagtagcttgtaagccaaacgaacgcacccaagcccgaactaagagatcactgctggccttagatgaagagtatgggctggaaggcttataccgactagttggtgtaaacttctcgccaacaccctcaccatggcccggtaaatcttcccgtaatggtaaatcaccgtatacttcatcagtggaaacatggtggaagcgtttgttaaacttatgtgcggattgaatcagcgtataagtcccaataatattcgtttcaatgaatggccatggatccttcaatgaattatcattatggctttcagcggcgtaatggacaaccgcgtcagtttgttgcattaattcatcaactaagggcgcatcacaaatgtcacccacaactaatttaacccggtcgcctagaattccttccaagttggcccgattaccagcgtaagttaacttatctaatactgtaatcttgacttcgggatgatgattataaacatagtgaacaaagttagagccaataaaaccggcaccaccggtaactaataagttttccatgacgtctccttaaatttcgccgtaaacaaacggattgttctgttcaaattttttaaaggtctgttgtttggcatccttatcagaagtaatagcttgatcatagtcaataggccagttaatatttaaatctttatccataaaggtaataccaccatcagcttcagcgttgtagtagttatcacacttgtataagaaattaacattatcagtcaatgtcacaaagccatgggcaaagccacggggaactaacaattgacggtggttactttcagagataatatagccttcccattccccgtacgtaggtgagccagcacgaacgtccacaataacatcaagcacggcaccagtcaccacgcgaattaatttagtttgcgctgccttaccacgttgaaaatgcagtccccgcaaaacacccgcttccgctgataacgattgattatcctgaatgaagtcaaaatcaatgccagcttctttgaagtcacgatccgagtatgtttccgtaaagaacccgcgcttgtcgccaaaaactgctggctcaataatcttaacatcttgtaacttagtcgttgttacctttaatttgcccaaaatttaagccctcccaattaatcttaataagtattgaccgtaatcattcttcttcaatggttgcgccaattcatacactttatcagcatcaatataacccattcgatacgccacttcttctaagcaagccacttttaaattctggcgtttttgaacggttgcgataaaactacttgcttcttgtaatgagtcatgggtcccagtatcaagccaagcaaaaccacgacccatgagttcaacatctaactcattatgctctaagtaaactttgttgatatccgtaatctccaattcaccacgtggtgatggttgaatattcttcgcaatatcaacaacttgattatcataaaaatacattcccgtgacagcataattactagctgggtgtgcaggcttttcaacaatggactttgcatgcatattttcatcaaagtcaacgacaccaaaccgttccggatcattgacatggtaaccaaagaccgtggcccccttcggcttagcgctagcatgctggagcatcttggataagccgccaccataataaatattatcacctaaaatcaggcagactgaatcatttccaatgaaatcagcacccaaaataaaggcttcagctaaaccgttcggcttttcttggacagcataggatagattcaagcccaaatcatgaccatcgcttaacagttctttgaaccgcggtgtatcaacaggtgttgaaataaccaaaatatcttggattcctgccaacattaacgtcgataacggataataaatcattggcttatcataaatcgggatcaattgttttgaaatcgcccgtgtaattggatacagccgtgtaccggatccccctgcaagaataattcccttcatttagagccctcctgaatagttgcttattttaattatatttctattttcaaaatattactacctaatgatagaagaaactaacaacatgtgtaaatagtcaacattaaataaaaattagattaaaaataactaacttaaacatttaactaatcactgaaaatttgggtagcgtcaagaatcttgtgtaaatgaaatgccttcgtacatataatatgtatctaacttaaataaatgatgcttccaaggtgtcctggagtcctttg

SEQ ID NO: 33 - DNA, 3617 bp, synthetic construct
  source 1..3617: mol_type = other DNA; note = Lactobacillus plantarum PDG8 - contig 33
aactgttaatagtctttttatttggtaaattctataattaatccgaacaaaaattaaaaaaagctcaaagcaatcactttccccctcacttataatatagacaataaatcattaaacaaaataattcttacgctgataatcccatttagcaataatctcacgcaccacttgatcaaccttttgatcatcactatccgtattaatcaaatcaccattttcaacgtcttccaattgcaactgtttgcgaatttctttcagtaacccaccataactaatttggcgggaaccagccaaagcttgttccagatcgtcaatcacctgtaagtcttgttctggattatgcgtcaaaatatctttagactttacctgatatttagccgtttcttgagcactggccaataaagaatttttatggcgattcacattcggtttaactgcctcaacattcacaactggcacataagttaatttcatagctcgttgccaatatccagtccattccgcctgtgaaatataattatcagttcccgtaaaatagcttgatttcataaaaagcaagacatgcatatgatggtgatacatcggctgatctacttcatgattaacggtcacttcagttgaacgcacatagcccagcaaatttttagccacttttttatattgaaaaatttttgcaattgcccgtcccatttgtcgtaattcactctttagttgctcaccagttgtattctcaaccgtcagcgttaaaaataagaaccgacctgtttttcgttgtttaactgcttctgccaaaatttgcgttaactgattagactgcttcattgcccgccgccaattgcacaaaggacacaaacgagaatgacaaaaccaagtctgcgctaatttcttatgaccttgttcatcttccacaaagcgcaaaacttccccacattctttaacccggtgagctttcttataattcaatatttgcaaatagtcaccatactgcaaattctctaacttacgctctcgccacggacgaactttccctgaccgagatttatcaactaaaacttttctatcagtcaaaataaaactcctctcatctggccacgtgagaagagttaatctgcatgtattactttactaaaatcagccagaagccttgacggtcaactacccaagccttaaactatgtctagtaaataaaaatacgattttacaagattaactcacgtgttcgaggtcgccaaactttcgaagctcacgtgggttttttttatattcattttataaactcataatacgcctaagcccagttgtgtcaagggtttatcccgattttttaaaatgacgttgtttctaatagtatcaagataagaagaaactggcaaaaaaacgccagtttcaacccctcgggtgctgacgccccgaacccagtctaagctgtgccagcttgaccgcctaaatgagcgggagctcccgctcaaactcaccccgcactcgccgtgaggcaggaaagcaaagtttaggaaactttggctttcagccaattcagtgtctgggtttggttagtcaatcaactccttaaagcctcaaaaagggactaactgctaaagcagtaagtccctttaattcgatttaccgttgactgacggccattaaacagctccaatactcatcagcggttaaattaaagccatagaccaaattcaaaggcttggaccatctaattcatcatgttgcccctctgaacgctcctgtggcctctgaggggcttttttagatagttcctttagtccagctcgctctagccactcatttggtaagccaacacctaatttgcgctgtaagaaccggtcaacgctccgaacaattccttgtaacgtatccactaatttttggagcttctcatttttcttgcttaaatcataattattgtctttaacttcaagcagttgataatttaggctttgattatcaagttttaaacggttctgttgttgattataaatatcactgacagctgctcgagattctaagtcatgaagatcactttttctaacaaccactttatccttgcttaaaaaagtaggtttgctctcaatttcctgctgatcacgaggtttaagttcagcaaggcgttttctggcatcttcaagttcagcttgtatttcttgtttttgaagcgtcgcctttttcaaatcttcccgcatagctttatattctggcaccgttaaacttttacgttccgattcttgaaccccacgttgaatattaaaaccatgctgttgcaaataagtcggtaattgatcttgaatatctcgcaaagccgtgcgattaaatactcgcttagcagacaacttatgttcatcatcaaagggcacaattcccatatgcatatgtggcgtactctcatcaagatgaacaattgcataacgaatattttcttcaccaaatttttcagcaaaataattcttcgctgtttcaaaatatttgcgggtatcagccgccgtcaaatcggcaaagaaattactatcgctcgaaataatccattcattgactaaaacggcatcttttctgaccgctcgctgactggttttatgctcgttaatataagcctcaatatccgttttgaaatggttagtccgaccagcaactaaatcataatttaagccagaacggtcaacgtcaatatcaatatttttgtgatgttgcgttcggcgttgatcatgattacccaagccaactaaattatcagcttttaatttctgcatattagccactaaataactcatttcaccactccattcccaaacagataaatttggttagagcatagcacagaattcggaaaacctccatgcaaggtatagcccaatatactttaccttgtaaagtttgggctctgcgaggccggttttgccgctggcaaaaaaaataataccttaacaatgttcatcaaaaataaaatttctcaaaacatgtaaaagttttctttgaatttctacaggttcagtttttcttttctcaaattctctaatataatcatcgctttgatcagcactcatatttctaagattattaccagatcctcgagtagctatcaattcatagtaagcgaacaacgattgcacgattttatccactatttcaagaatactatttggaattgcaagagttccttcaacaaaatttctcaaagctagtaaatcactattcaaatcaggaatagaatctttaccggcatattctccaattttattatgaagtgctccagctttctcaaaaaaaatatttataaattcctgcaaaacaacaaacatattagaattatcagtataatttgtaacttcagaaatgaattttacatcagaattactaataatattaccgttaaaattaccagaagaagtattagaacaattatcttgactggtctgattaccttttttcatgcttctcaccttcactattatcaacattgacactagaattatcgatattattaccattgaaacttcccttaatatttttcgaactgttaatagtctttttatttggtaaattctataattaatccgaacaaaaattaaaaaaagctcaaagcaatcactttccccctcacttataatata

SEQ ID NO: 34 - DNA, 3359 bp, synthetic construct
  source 1..3359: mol_type = other DNA; note = Lactobacillus plantarum PDG8 - contig 34
ggggagtacaagtatgcattggagaaactatgttgcgcaagttgacgagatggactgtggggtcgcagctttagcaatgattttgaaaaattatggttcgacaacatcattggcctatctaagaaatattgctaaaacgagtttagaagggactacggcattaggattagtaaaaacggccgaaaagttaggttttgaaaccaaagcaattcaagcagatatgagtcttttcgatgtccaagatttaccattgccattcattgtgcatgttaccaaaaatggggatctacagcatttttatgttgttgtaaaaacctcgaaaacgcatgtcgtgattgctgatccggacccaacagttgcggttatcagtatgtcaaaggaacggtttgaaagcgaatggtccggagttgcccttttctttgcaccgaagtcggaatataagccagttaagcaagataagggctcactatggggatttattccaagcttattaaagcagcgccgactggttattaatattgtgcttgctgcagttttaatcacgattattagtatctgtgggtcttatttcttacaagcggtgattgatacttatattcccaataatatgcacagtacattggcagtggtggccattggtctaatcgttttttatacctttcaggctatctttacttatgcccagaattttttattggcggttttaggtcaacgactttcgattgaaattattttaggctatattcggcacgtctttgaattgccaatgagtttttttgccactcggcggacgggggaaattgtttcaaggtttacggatgccagtaagattattgatgcgttagctagcacaattgtttcgctgtttttagatgtcagcatcgttattattatgggggcaatcttggtaatccagaatatgacacttttttggattacgttactctcgttgccaatctacgcggttgtcatcttagcctttaataaatcctttgaacgattgaatcaaaaggaaatggaaagcaatgctattttgagttcagccattattgaggatcttcatgggattgaaactgttaaggcgctgaatggtgagacggaacgttatcagaaaattgattcagaatttgttgattatctacgtaagagtttagcctatcttaaagcggatactttgcaacaggcattaaaactgtttatacagttagtcttagaagttgttgttctatgggtgggcgccaatctcgtcattcataatcagttatcagttggggagctcatgacatataatgctttattagcctattttgttaatccactacagaatattattaatttgcagactaagcttcaaagcgctaaggtcgctaacaaccggttaaatgaagtgtatttggtcgctagtgaatttgaggcgtcacggccaattcataatgaaagtcaattaaatggtgatattaagttacaaggggtcagctatcgttatggttacggtgaaaatgtcttagatgatgttaatttgacgattcgacaacatgataaggttgcaattgtggggatgagtggctctggcaagtccacgttagttaaattgcttattgatttttatcaaccaaatagtggtgatgtcatattgaacggcttcaacgttaagaacatcgacaagcatacattgcggacctatattaactacatcccgcaggaaccatacatcttttcagcgaccattgaagaaaatttaagattaggtaatcgcagcggtattactgagaaagatattgcgaaggcttgccaactggcgttaattgatacggatattaataaaatggccatgcaataccaaactaagctagatgagaatggtaatacactatcaggtggtcagcgacaacgattaacgattgcgagagcgttattatcacccgctcaagtcttgatatttgatgagtcgacgagtggactggatgcaattactgaaaaacaattaatcgataatttagtggcaatgactgacaagacgattatttttattgcccaccggttgtcgattgcaaagcggacgaatcatatcatcgttctgcatgatggtcgggtcgctgaagaggggacccatgcggcattgttgaatgaacatggttactattacgacttgatcaatagctgaggggggaactgaataatgagaaaagacctgctcgaaagtggcgagttttacgggattcggtttcaaaatttttcaacattactaattattccagtgacgctattgttaatgggtacgattctgttttcactcgtagctaagcgcgagattgttattaatggtactggaactgttcaaccgaccggaacggttccggtgattcaagcgactgtcaatagtgccatcaaaaagaattatttagttgaaggtgcgcgagtgaagaagggtcaaaagctattagtttatactaacgtttttaatcgcaataaattacgcgaagataatgtcagcaaacggcaattgcaacgccaagtgacagccttggatcattttaaagatggcatcaatactgacagtgatgtttttccaacgaccgatgaatttgggtaccgagaactattgcaaagttatttaaaacagcgtcaaatctatttaacggagaatcaaatgttggcagcaaaatcgagcgctgctagtattaagaaagccacgctaacgaagaccgcgcaacaagtggtatcaaatactaagaccagtctggatgcttatcaagccttatacaatgcggtggctaatggtagcaagtatgccaatagtgccaagtatgggtctgtttttaatgagtatgtcgctaagtcaaaggaggccaacaacgcaaacgataaaaaagaagttaaatctgcaacgttagcagacattcaacagcagatagatacgcttcaggattcgttgtcctcagctaaagtgcagttagaagaattacaagactttgatgatacgaagtacagtgttgagactaacaataccaaattagccatgttaaagaatgatcagttaagcgaagtcgctgagaaacgaatgaaagccgagcaagatttacggaccgtgaaagcagatattgatagcttaacgacacaatcaaaatcttacacgatcaaggcaaccaaagccggcgtcctacacgttgcagacaattaccgtggtgcaaagtacgttagttcaggagctgaaatcgctaaaattttaccgataatcaagcaacaacggcgagtgaacgttaagctatatatttcgacggcggatatttcttccgttaaagtcaagcaagccattagattcaaagtcacgcggaacgtaccgaagccaattattttgg

SEQ ID NO: 35 - DNA, 3237 bp, synthetic construct
  source 1..3237: mol_type = other DNA; note = Lactobacillus plantarum PDG8 - contig 35
aaacttgttctttgaaaactagataatatcaaatatattttttcataatgaaaccgagaacaccgcgttttttgagttttttattgaagtttaattatcgctaaactcattaatcgcatttaccattaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtcttgtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattagctagttttgagagcacaagtttctcaatagtgtggtgacgatggcgagaaggatacacctgttcccatgtcgaacacagaagttaagcttcttagcgccgagagtagttgggggatcgctccctgcgagggtaggacg

SEQ ID NO: 36 - DNA, 1684 bp, synthetic construct
  source 1..1684: mol_type = other DNA; note = Lactobacillus plantarum PDG8 - contig 36
ttttgaatcaagagcaaaacatttgcgaagtcaattcgctagcaaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaatattacggaaacctacaca

SEQ ID NO: 37 - DNA, 1655 bp, synthetic construct
  source 1..1655: mol_type = other DNA; note = Lactobacillus plantarum PDG8 - contig 37
ctacctaaggaggagtttttctatgggcagaaaaggttctcgctatacgattaaagagaagttgttttacattggtctagttactcagggaatggctcctaatgccgttcaaagaaaatatggagttgaacatagtcaagtaagccgatgggtaaagcgttatggattacaggggatcgatggcctgcggcatcgactcatgggaaagtatccaagtgaattgaaattaaaaatagttctggagtacctagaaggacacagttcttatcctcgattatgcgataaatataatattcctaacgttagtactatctatcaatgggttcatcagtatactagtggtaaacaactcaccactaggagtgtgaaacaagtgaaagatggtcggaaaacaacccagctggaacgtgtagaaattgttcaatggattatagcaaacgatatggattactcacgcgccatgaataagtacaacgtgtcatatggtcaggtttactcgtggactcggaagtttaaacaaggtggaccagaagcccttgtcgatcgtcgtggtaagggaaagactgtgcatgaccagcttacagataacgagaagcgtgacctggaggtcaagcgtctaaaggcccgaattgaacatttatcgacagagaatgcagttctaaaaaaactccaagaattggaaaggttggatgccactcatcacacatctacgaaacaatccaaactttagcaactacggtgaaccctgatacaaaccaagtttatgggattagttttatgtgtcgttttatgaaagtctcacgtgctgcatattacaaatggatacaccgaaccccaagcaaacgtgctctggaagataaagagatattaaagtacgtcaaaattattgaagaggagaacgaatatacccttggagtacgaagattaatgatgaatcttcattgcgatacaacatatcgaactagtgctggaaaaatgcgccggatcatgcgtgaaaatggtatcgtggcttcaattcgcgtggcacagcatgatcgaaaagctcaacggaaagagcacatcagcaataacctcctcctttcagatgaaggccataattttaagccagacaagccaaatcaggtctgggtaactgattgtacagagctatgttttggttggaaattcagtgaacgtttgagacttagtgcaattaaagacctgaacgaccacagtatcattgcttgggacattgaagaaactgagacagccgatttggtgactcgaacatttgataaggcattagcaataagcaatggtgcaaaaccaacggttttacactcagatcagggatcaagctatacatctggagtatttaacaaacatctagctagcaatggggttaagcatagtatgtcgcgtccaggaacccctggagataacagtcctatggaaagcttctggagtcatatgaagaccgagttctttaattttcaccatgcattaaatcgagaagaaatggttcaacttatcgaaaaatgtattaactggtataactacaagcgtcgccaagaaacactaaatggcatgaccccgaaagaatttcggaatcatgccattctaaaaactgcatagctattttaattatttgaactgtctacttgactcggagcagt

SEQ ID NO: 38 - DNA, 1416 bp, synthetic construct
  source 1..1416: mol_type = other DNA; note = Lactobacillus plantarum PDG8 - contig 38
aaaggactccaggacaccttggaagcatcatttatttaagttagatacatattatatgtacgaaggcatttcatttacacaagattcttgacactccctatataatgagtaaagtgcttagatagagcaagccaggtcacaacttaacagttgtggcctcttttttgatactgtataattaaagggttagaaccgtgccattacttaatgacataagtaaggagataaaaagatgaaatatggctatgcgcgggtcagtaccactgatcaaaaattagcaaatcaaattgagttactaaaattggcaggagcagaaaaaatctttcaagaaaagtttaccggcacaactactgaacgaccggagtttcaaaaactgttgcgcgttctaaaaacaggcgatactttgattgttactaagttggatcggtttgcacggaacacgcgcgaggccttagccattatccaagagttgtttaaagaaaatgtcaaagtcaacattttgaatatgggcttaattgacaatacgccgactggccaactagtctttacaatatttagcgcctttgcgcagtttgaacgcgatatgattgtcacgcgcacacaagaaggtaaattgtatgccaagcaacatgatccgttgtttcgggaagggcgaccgaaaacgtattctgatgaacagatcagatttgcttatgagttgcgaaaacaaggcatgacttataagatgattgaacgaaagacggggattagtaaacgcacgcaacagcgaaggtttaagtcgatttaatttaagaattgaatgtttaattaatcacgtacgacggggattgccgctttattaaacagttgtgagagaagtttatttagggattttaggcactatttatacctgttgtgctattgaggttagttgtgataaggattaatttgtactacaaaaggcctactcaattgttagttgagcaggccttttgtgggtattttgattagagctattaaccctatgctaattataaggcttagctttcaaatggaacatactattatccaaattatgatttgttaaggtggtgttgtcatagttactgaattgaatcaattgggcagaaacaagaaaaatttaactaagaccatggacaccattcaaaattaagggaaggtcatcctaaatctattgccaatggcgggaattgttgatttttatttatgccaactcgtgaccacatcttatcattggatggtatgaatgatgttgacagaaaaactagcattagagacctccttattatatatagtaaaggatactaaacgaaatagagggagtgtcaagaatcttgtgtaaatgaaatgccttcgtacatataatatgtatctaacttaaataaatgatgcttccaaggtgtcctggagtccttt

SEQ ID NO: 39 - DNA, 1168 bp, synthetic construct
  source 1..1168: mol_type = other DNA; note = Lactobacillus plantarum PDG8 - contig 39
gtcaagaatcttgtgtaaatgaaatgccttcgtacatataatatgtatctaacttaaataaatgatgcttccaaggtgtcctggagtcctttgaaccctcggtggatccgcttcagagacttctcgttataaacattaaactgagaaaccaggaagcgatccagtgaatcttccgttggaaattgttctttgtgatgggtggtgcgcttgagatgcttattaaagttctcaatcaggttagtggcgtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaa

SEQ ID NO: 40 - DNA, 911 bp, synthetic construct
  source 1..911: mol_type = other DNA; note = Lactobacillus plantarum PDG8 - contig 40
acctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagggcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatacgattacgttgattaatcatcatgggacgctgttcaattgatcgccccaaagattgattatatttggatcgttggtcaacgttacgccgttggcgtacgccatgttcaggtagatcattcaaggagaaaccaattctctcctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagacaaaagatcagctcctaa

SEQ ID NO: 41 - DNA, 882 bp, synthetic construct
  source 1..882: mol_type = other DNA; note = Lactobacillus plantarum PDG8 - contig 41
agaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgccctgctttataccttgaaaaatgggtgcgtttggcgcgatttacccagcgattttcctaaatgggaaaccgtctattattactggttactttggactaaaacgccatctcctgctggtatcactcctctggataaggttttaaaaaaattgtcagccaacatcggttggctcagaagcgttcagtttatacatcgttcgtcattctagatgctcaaagtgtcaagaataccgatcctgctgaaagtagcggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacagtttgacctggttcaacgagtaatggccgatggtggttatactggtaacaactttgctcaatcagttcaggcaatgattaacgctgaagtcattattgctaaacagagtgaccttaggcacggtcaagtgaccccgcaacgctgggttatcgaacgcagttttagctggctaggaaaatatcggcgcctctggcgcaattgtgagcgaaagctgaacaccagtaagatgatgattagcttagccttcctgcgaatactcttgaaaagattctaaacacgttct

SEQ ID NO: 42 - DNA, 697 bp, synthetic construct
  source 1..697: mol_type = other DNA; note = Lactobacillus plantarum PDG8 - contig 42
cacctaaacgatacgaactggaagatgctcagtgggaccgaatcaaaggatacttcccgccataccggactggccgtccatcaagcctagacaaccgtaccgccctcaacgctatcctctggctcatgcgcagcggggctccttggcgtgatctacctgaacgctatggctcttggaaaacggtgtatagtcgcttccgagcctgggtaagttcaggcttgttcgaacaggtttttctcgaattgattgacgatcccgacatggaaaacttgagcttagattcaacgatcgttcgagcgcatcaaaaggccactggggcaaaaaaaatgccgaatgtatggtcgaaaatcaagctattggattaagtcgaggtggccgaacgaccaagattcacgcactcgttgacggattagggaatcccttgggttttcgcctaacaggtggtcaagtacatgatagccaagttgccagtgagttgctggaaggcttcgatatttctcaatcaaatattatcgcggataaagcctatggcaccgcgaaacttcgccagtatattgaagataaagcaggcgtctataccattccgccaaaggaaaataccaaagacaagtggacctgtgattaccacgtttattgtgagcgccatttgattgagaacttcttcaatcagttgaagaactttcgtaggattgcaacg
